US008334365B2

(12) United States Patent
Rosen et al.

(10) Patent No.: US 8,334,365 B2
(45) Date of Patent: Dec. 18, 2012

(54) ALBUMIN FUSION PROTEINS

(75) Inventors: Craig A. Rosen, Laytonsville, MD (US); David W. LaFleur, Washington, DC (US)

(73) Assignee: Human Genome Sciences, Inc., Rockville, MD (US)

( * ) Notice: Subject to any disclaimer, the term of this patent is extended or adjusted under 35 U.S.C. 154(b) by 960 days.

(21) Appl. No.: 11/759,843

(22) Filed: Jun. 7, 2007

(65) Prior Publication Data

US 2009/0029914 A1 Jan. 29, 2009

Related U.S. Application Data

(60) Provisional application No. 60/811,405, filed on Jun. 7, 2006.

(51) Int. Cl.
*C07K 14/00* (2006.01)
*C12P 21/00* (2006.01)

(52) U.S. Cl. .......................................... 530/350; 514/2

(58) Field of Classification Search ........................ None
See application file for complete search history.

(56) References Cited

U.S. PATENT DOCUMENTS 4,456,748 A 6/1984 Goeddel
4,530,901 A 7/1985 Weissmann
4,569,908 A 2/1986 Mark et al.
4,716,217 A 12/1987 Caruthers et al.
4,734,491 A 3/1988 Caruthers et al.
4,758,428 A 7/1988 Mark et al.
4,966,843 A 10/1990 McCormick et al.
5,002,764 A 3/1991 Peets et al.
5,326,859 A 7/1994 Sugano et al.
5,376,567 A 12/1994 McCormick et al.
5,378,823 A 1/1995 Martal et al.
5,480,640 A 1/1996 Morales et al.
5,514,567 A 5/1996 Sugano et al.
5,540,923 A 7/1996 Ebbesen et al.
5,695,750 A 12/1997 Doctor et al.
5,795,779 A 8/1998 McCormick et al.
5,876,969 A 3/1999 Fleer et al.
6,001,625 A 12/1999 Broomfield et al.
6,069,133 A 5/2000 Chiou et al.
6,905,688 B2 6/2005 Rosen et al.
7,138,371 B2 11/2006 DeFrees et al.
7,271,149 B2 9/2007 Glaesner et al.
7,482,013 B2 * 1/2009 Ballance et al. ........... 424/192.1
2002/0119489 A1 8/2002 Lockridge et al.
2003/0147918 A1 8/2003 Maertens et al.
2003/0187226 A1 10/2003 Goodey et al.
2003/0199043 A1 10/2003 Ballance et al.
2003/0219875 A1 11/2003 Rosen et al.
2004/0016005 A1 1/2004 Karatzas et al.
2005/0239167 A1 10/2005 Fleer et al.
2005/0266533 A1 12/2005 Ballance et al.
2006/0014254 A1 1/2006 Haseltine et al.
2006/0051859 A1 3/2006 Fu et al.
2007/0162986 A1 7/2007 De Bold et al.
2008/0194481 A1 * 8/2008 Rosen et al. .................... 514/12
2008/0267962 A1 10/2008 Ballance et al.
2009/0029914 A1 1/2009 Rosen et al.
2011/0002888 A1 1/2011 Rosen et al.

FOREIGN PATENT DOCUMENTS

CA 2070781 2/1991
EP 0 147 193 A2 7/1985
EP 0 130 967 A1 9/1985
EP 0 215 658 A2 3/1987
EP 0 591 524 4/1994
EP 1 832 599 A2 9/2007
WO WO 90/13653 11/1990
WO WO 91/07483 5/1991
WO WO 91/07483 A2 5/1991
WO WO 94/03198 2/1994
WO WO 95/23158 A1 8/1995
WO WO 96/18412 6/1996
WO WO 97/24445 7/1997
WO WO 98/12344 3/1998
WO WO 99/66054 12/1999
WO WO 01/79271 A1 10/2001
WO WO 03/060071 A2 7/2003
WO WO 2005/077042 A2 8/2005
WO WO 2007/021494 A2 2/2007
WO WO 2007/146038 A2 12/2007
WO WO 2009/058322 A1 5/2009

OTHER PUBLICATIONS

International Search Report and Written Opinion mailed Jul. 30, 2008, for International Application No. PCT/US07/13383, filed Jun. 7, 2007.

Murray G.J. , et al., "Gaucher's Disease: Lack of Antibody Response in 12 Patients Following Repeated Intravenous Infusions of Mannose Terminal Glucocerebrosidase," *Journal of Immunological Methods*, vol. 137, No. 1, pp. 113-120 (1991).

Lee et al., "Improved Intracellular Delivery of Glucocerebrosidase Mediated by the HIV-1 TAT Protein Transduction Domain", *Biochemical and Biophysical Research Communications*, vol. 337, No. 2, pp. 701-707 (2005).

Extended European Search Report mailed Sep. 14, 2009, for European Application No. 07809374.7.

Halpern W., et al., "Albugranin™, a Recombinant Human Granulocyte Colony Stimulating Factor (G-CSF) Genetically Fused to Recombinant Human Albumin Induces Prolonged Myelopoietic Effects in Mice and Monkeys," Pharmaceutical Research, vol. 19, No. 11, pp. 1720-1729 (2002).

(Continued)

*Primary Examiner* — Anand Desai

(74) *Attorney, Agent, or Firm* — Finnegan, Henderson, Farabow, Garrett & Dunner, LLP

(57) ABSTRACT

The present invention encompasses albumin fusion proteins. Nucleic acid molecules encoding the albumin fusion proteins of the invention are also encompassed by the invention, as are vectors containing these nucleic acids, host cells transformed with these nucleic acids vectors, and methods of making the albumin fusion proteins of the invention and using these nucleic acids, vectors, and/or host cells. Additionally the present invention encompasses pharmaceutical compositions comprising albumin fusion proteins and methods of treating, preventing, or ameliorating diseases, disorders or conditions using albumin fusion proteins of the invention.

14 Claims, 6 Drawing Sheets

OTHER PUBLICATIONS

Osborn B.L., et al., "Albutropin: A Growth Hormone-Albumin Fusion with Improved Pharmacokinetics and Pharmacodynamics in Rats and Monkeys," European Journal of Pharmacology, vol. 456, pp. 149-158 (2002).

Osborn B.L., et al., "Pharmacokinetic and Pharmacodynamic Studies of a Human Serum Albumin-Interferon-α Fusion Protein in Cynomolgus Monkeys," The Journal of Pharmacology and Experimental Therapeutics, vol. 303, No. 2, pp. 540-548 (2002).

Huang Y.-J., et al., "Substantially Improved Pharmacokinetics of Recombinant Human Butyrylcholinesterase by Fusion to Human Serum Albumin," BMC Biotechnology, vol. 8, No. 50, 11 pages (2008).

Extended European Search Report mailed Oct. 15, 2010, for European Application No. 08843705.8.

Abstract of Nossent et al. (2006), *J. Thromb. Haem*. 4:12, pp. 2556-2562.

Doctor, B.P., et al., "Enzymes as Pretreatment Drugs for Organophosphate Toxicity," *Neuroscience & Biobehavioral Reviews* 15:123-128 (1991).

European Supplemental Search Report and Opinion for EP06813242 dated Jun. 19, 2009.

Extract from U.S. Food and Drug Administration- derived package insert for Abbokinase (Urokinase), Nov. 25, 2008 http://www.fda.gov/cder/foi/label/2002/urokabb101002LB.htm.

Extract from Johns Hopkins product information regarding G-CSF Nov. 25, 2008 http://prod.hopkins-abxguide.org/antibiotics/biological/g-csf.html?contentInstanceId+....

Yeh, P., et al., Design of yeast-secreted albumin derivatives for human therapy: Biological and antiviral properties of a serum albumin-CD4 genetic conjugate, *Proc. Natl. Acad. Sci. USA* 80:1904-1908 (1992).

Hidaka et al., "Genetic Analysis of a Japanese Patient With Butyrylcholinesterase Deficiency," Ann. Hum. Genet. 61:491-496 (1997).

GeneID: 590, "BCHE butyrylcholinesterase," Entrez Gene (updated Nov. 14, 2007).

GeneID: 1110, "CHE2 cholinesterase (serum) 2," Entrez Gene (updated Aug. 28, 2008).

NP_000046, "butyrylcholinesterase precursor [*Homo sapiens*]," (updated Oct. 5, 2009).

Belfiore, F. et al., "Serum Enzymes in Diabetes Mellitus," *Clin. Chem*. 19:447-452 (1973).

Blong, R.M. et al., "Tetramerization Domain of Human Butyrylcholinesterase is at the C-Terminus," *Biochem. J*. 327:747-757 (1997).

Brimijoin, S. et al., "Immunochemistry of Mammalian Cholinesterases," *FASEB* 45:2960-2964 (1986).

Brimijoin, S. et al., "Immunology and Molecular Biology of the Cholinesterases: Current Results and Prospects," *International Review of Neurobiology* 28:363-410 (1986).

Das, P.K. et al., "On Genetically Determined Human Serum Cholinesterases," *Enzyme* 21:253-274 (1976).

Delbruck, A. et al., "A Rare Genetically Determined Variant of Pseudocholinesterase in Two German Families With High Plasma Enzyme Activity," *Eur. J. Biochem*. 99:65-69 (1979).

Gorelick, D.A. et al., "Enhancing Cocaine Metabolism With Butyrylcholinesterase as a Treatment Strategy," *Drug and Alcohol Dependence* 48:159-165 (1997).

Harris, H. et al., "Differential Inhibition of Human Serum Cholinesterase With Fluoride: Recognition of Two New Phenotypes," *Nature* 191:496-498 (1961).

Jensen, F.S. et al., "Identification of Human Plasma Cholinesterase Variants Using Molecular Biological Techniques," *Acta Anaesthesiol. Scand*. 39:142-149 (1995).

Mack, A. et al., "The Key Role of Butyrylcholinesterase During Neurogenesis and Neural Disorders: An Antisense-5' Butyrylcholinesterase-DNA Study," *Progress in Neurobiology* 60:607-628 (2000).

Main, A.R. et al., "Kinetic and Structural Relationships of Transition Monomeric and Oligomeric Carboxyl- and Choline-Esterases," *J. Environ. Sci. Health*, B18(1):29-63 (1983).

Massoulie, J. et al., "Structure and Functions of Acetylcholinesterase and Butyrylcholinesterase," *Progress in Brain Research* 98:139-146 (1993).

McTiernan, C. et al., "Brain cDNA Clone for Human Cholinesterase," *Proc. Natl. Acad. Sci. USA* 84:6682-6686 (1987).

Neville, L.F. et al., "Intramolecular Relationships in Cholinesterases Revealed by Oocyte Expression of Site-Directed and Natural Variants of Human BCHE," *EMBO J*. 11:1641-1649 (1992).

Panteghini, M. et al., "Methods for Serum Cholinesterase Assay and Classification of Genetic Variants," *Clinica Chimica Acta* 183:87-90 (1989).

Communication with European Search Report, mailed Oct. 22, 2007, for EP Application No. 06076852.0 (7 pages).

Prody, C.A. et al., "Isolation and Characterization of Full-Length cDNA Clones Coding for Cholinesterase From Fetal Human Tissues," *Proc. Natl. Acad. Sci. USA* 84:3555-3559 (1987).

La Du, B.N. et al., "Molecular Biology of Human Serum Cholinesterase," *FASEB* 45:2965-2969 (1986).

La Du, B.N., "Identification of Human Serum Cholinesterase Variants Using the Polymerase Chain Reaction Amplification Technique," *TiPS* 10:309-313 (1989).

LaMotta, R.V. et al., "Molecular Heterogeneity of Human Serum Cholinesterase," *Clin. Chem*. 17:135-144 (1971).

Lockridge, O. et al., "Comparison of Atypical and Usual Human Serum Cholinesterase," *J. Biol. Chem*. 253:361-366 (1978).

Lockridge, O. et al., "Interchain Disulfide Bonds and Subunit Organization in Human Serum Cholinesterase," *J. Biol. Chem*. 254:8324-8330 (1979).

Lockridge, O. et al., "Loss of the Interchain Disulfide Peptide and Dissociation of the Tetramer Following Limited Proteolysis of Native Human Serum Cholinesterase," *J. Biol. Chem*. 257:12012-12018 (1982).

Lockridge, O. et al., "Complete Amino Acid Sequence of Human Serum Cholinesterase," *J. Biol. Chem*. 262:549-557 (1987).

Lockridge, O. et al., "Location of Disulfide Bonds Within the Sequence of Human Serum Cholinesterase," *J. Biol. Chem*. 262:12945-12952 (1987).

Lockridge, O., "Structure of Human Serum Cholinesterase," *BioEssays* 9:125-128 (1988).

Lynch, T.J. et al., "Cocaine Detoxification by Human Plasma Butyrylcholinesterase," *Toxicology and Applied Pharmacology* 145:363-371 (1997).

Whittaker, V.P. et al., "The Cholinesterases: A Discussion of Some Unanswered Questions," *Progress in Brain Research* 98:155-159 (1993).

Bellon et al., "Chemical Structure of Two Fragments of Human Serum Albumin and their Location in the Albumin Molecule," *Biochem. J*. 147:585-592 (1975).

Carmona et al., "Plasma Butyrylcholinesterase Activity and Cocaine Half-Life Differ Significantly in Rhesus and Squirrel Monkeys," *Life Sciences* 59:939-943 (1996).

Carmona et al., "Butyrylcholinesterase Accelerates Cocaine Metabolism: in Vitro and in Vivo Effects in Nonhuman Primates and Humans," *Drug Metabolism and Disposition* 28:367-371 (Mar. 2000).

Partial European Search Report EP06076852 dated Aug. 6, 2007.

Dockal et al., "Five Recombinant Fragments of Human Serum Albumin—Tools for the Characterization of the Warfarin Binding Site," *Protein Science* 9:1455-1465 (2000).

Duysen E.G., et al., "Wild-type and A328W mutant human butyrylcholinesterase tetramers expressed in Chinese hamster ovary cells have a 16-hour half-life in the circulation and protect mice from cocaine toxicity," J. Pharmacol. Exp. Ther. 302(2): 751-8 (2002).

Hoffman et al., "Administration of Purified Human Plasma Cholinesterase Protects Against Cocaine Toxicity in Mice," *Clinical Toxicology* 34:259-266 (1996).

Mattes et al., "Cocaine and Butyrylcholinesterase (BChE): Determination of Enzymatic Parameters," *Life Sciences* 58:PL257-261 (1996).

Minchiotti et al., "The Molecular Defect in a COOH-Terminal-Modified and Shortened Mutant of Human Serum Albumin," *J. Biol. Chem*. 264:3385-3389 (1989).

Nachon F., et al., "Engineering of a monomeric and low-glycosylated form of human butyrylcholinesterase," Eur. J. Biochem., vol. 269, pp. 630-637 (2002).
Peach et al., "Albumin Rugby Park: A Truncated Albumin Variant Caused by a G→C Splice-Site Mutation in Intron 13," *Biochimica et Biophysica Acta* 1180:107-110 (1992).
Takahashi et al., "Structural Changes and Metal Binding by Proalbumins and Other Amino-Terminal Genetic Variants of Human Serum Albumin," *PNAS* 84:7403-7407 (1987).
Watkins et al., "cDNA and Protein Sequence of Polymorphic Macaque Albumins That Differ in Bilirubin Binding," *PNAS* 90:2409-2413 (1993).
Xie et al., "An Improved Cocaine Hydrolase: The A328Y Mutant of Human Butyrylcholinesterase is 4-fold More Efficient," *Molecular Pharmacology* 55:83-91 (1999).
Quon et al. (Drug Metabolism and Disposition, vol. 13, No. 4 (1985), pp. 420-424).
Guo et al. (PNAS, vol. 101, No. 25, pp. 9205-9210, 2004).
Seffernick et al. (J. Bacteriology, vol. 183, pp. 2405-2410, 2001).
Wells (Biochemistry, vol. 29, pp. 8509-8517, 1990).
Yuile et al., "Plasma Protein Turnover and Tissue Exchange," Sep. 1958, pp. 173-186.
Galliano M. et al., FEBS Letters 208:364-368 (1986).
Galliano M. et al., FEBS Letters 233:100-104 (1988).
Galliano M. et al., Proc. Natl. Acad. Sci. USA 87:8721-8725 (1990).
Galliano M. et al., J. Biol. Chem. 261:4283-4287 (1986).
Hershfield Ms et al., Proc. Natl. Acad. Sci. USA 88:7185-7189 (1991).
Minchiotti L et al., Biochimica et Biophysica Acta 1119:232-238 (1992).
Peters T., Clin. Chem. 23:5-12 (1977).
Reed RG et al., Clin. Chem. 34:1992-1994 (1988).
Weitkamp LR et al., Ann. Hum. Genet. 36:381-392 (1973).
Weitkamp LR et al., Ann. Hum. Genet. 37:219-226 (1973).
International Search Report for PCT/US06/29391 mailed on Jun. 1, 2007.
International Search Report for PCT/US08/12306 mailed on Mar. 26, 2009.
International Preliminary Report on Patentability issued May 14, 2010 and Written Opinion mailed Mar. 26, 2009, for International Patent Application No. PCT/US2008/012306, filed Oct. 30, 2008.
Supplementary European Search Report for EP 01934875 dated Jun. 4, 2003.
International Search Report for PCT/US01/12009 mailed on Aug. 22, 2001.
Sun H., et al., "Cocaine Metabolism Accelerated by a Re-Engineered Human Butyrylcholinesterase," Journal of Pharmacology and Experimental Therapeutics, vol. 302, No. 2, pp. 710-716 (2002).
Gao Y., et al., "An albumin-butyrylcholinesterase for cocaine toxicity and addiction: catalytic and pharmacokinetic properties," Chem. Biol. Interact. 175(1-3):83-7 (2008) (Author Manuscript).

* cited by examiner

```
  1 GAT GCA CAC AAG AGT GAG GTT GCT CAT CGG TTT AAA GAT TTG GGA GAA GAA AAT TTC AAA 60
  1 D   A   H   K   S   E   V   A   H   R   F   K   D   L   G   E   E   N   F   K   20

 61 GCC TTG GTG TTG ATT GCC TTT GCT CAG TAT CTT CAG CAG TGT CCA TTT GAA GAT CAT GTA 120
 21 A   L   V   L   I   A   F   A   Q   Y   L   Q   Q   C   P   F   E   D   H   V   40

121 AAA TTA GTG AAT GAA GTA ACT GAA TTT GCA AAA ACA TGT GTT GCT GAT GAG TCA GCT GAA 180
 41 K   L   V   N   E   V   T   E   F   A   K   T   C   V   A   D   E   S   A   E   60

181 AAT TGT GAC AAA TCA CTT CAT ACC CTT TTT GGA GAC AAA TTA TGC ACA GTT GCA ACT CTT 240
 61 N   C   D   K   S   L   H   T   L   F   G   D   K   L   C   T   V   A   T   L   80

241 CGT GAA ACC TAT GGT GAA ATG GCT GAC TGC TGT GCA AAA CAA GAA CCT GAG AGA AAT GAA 300
 81 R   E   T   Y   G   E   M   A   D   C   C   A   K   Q   E   P   E   R   N   E   100

301 TGC TTC TTG CAA CAC AAA GAT GAC AAC CCA AAC CTC CCC CGA TTG GTG AGA CCA GAG GTT 360
101 C   F   L   Q   H   K   D   D   N   P   N   L   P   R   L   V   R   P   E   V   120

361 GAT GTG ATG TGC ACT GCT TTT CAT GAC AAT GAA GAG ACA TTT TTG AAA AAA TAC TTA TAT 420
121 D   V   M   C   T   A   F   H   D   N   E   E   T   F   L   K   K   Y   L   Y   140

421 GAA ATT GCC AGA AGA CAT CCT TAC TTT TAT GCC CCG GAA CTC CTT TTC TTT GCT AAA AGG 480
141 E   I   A   R   R   H   P   Y   F   Y   A   P   E   L   L   F   F   A   K   R   160
```

Figure 1A

```
481 TAT AAA GCT GCT TTT ACA GAA TGT TGC CAA GCT GCT GAT AAA GCT GCC TGC CTG TTG CCA 540
161 Y   K   A   A   F   T   E   C   C   Q   A   A   D   K   A   A   C   L   L   P   180

541 AAG CTC GAT GAA CTT CGG GAT GAA GGG AAG GCT TCG TCT GCC AAA CAG AGA CTC AAA TGT 600
181 K   L   D   E   L   R   D   E   G   K   A   S   S   A   K   Q   R   L   K   C   200

601 GCC AGT CTC CAA AAA TTT GGA GAA AGA GCT TTC AAA GCA TGG GCA GTG GCT CGC CTG AGC 660
201 A   S   L   Q   K   F   G   E   R   A   F   K   A   W   A   V   A   R   L   S   220

661 CAG AGA TTT CCC AAA GCT GAG TTT GCA GAA GTT TCC AAG TTA GTG ACA GAT CTT ACC AAA 720
221 Q   R   F   P   K   A   E   F   A   E   V   S   K   L   V   T   D   L   T   K   240

721 GTC CAC ACG GAA TGC TGC CAT GGA GAT CTG CTT GAA TGT GCT GAT GAC AGG GCG GAC CTT 780
241 V   H   T   E   C   C   H   G   D   L   L   E   C   A   D   D   R   A   D   L   260

781 GCC AAG TAT ATC TGT GAA AAT CAG GAT TCG ATC TCC AGT AAA CTG AAG GAA TGC TGT GAA 840
261 A   K   Y   I   C   E   N   Q   D   S   I   S   S   K   L   K   E   C   C   E   280

841 AAA CCT CTG TTG GAA AAA TCC CAC TGC ATT GCC GAA GTG GAA AAT GAT GAG ATG CCT GCT 900
281 K   P   L   L   E   K   S   H   C   I   A   E   V   E   N   D   E   M   P   A   300

901 GAC TTG CCT TCA TTA GCT GCT GAT TTT GTT GAA AGT AAG GAT GTT TGC AAA AAC TAT GCT 960
301 D   L   P   S   L   A   A   D   F   V   E   S   K   D   V   C   K   N   Y   A   320
```

Figure 1B

```
                                  .           .           .           .           .
 961 GAG GCA AAG GAT GTC TTC CTG GGC ATG TTT TTG TAT GAA TAT GCA AGA AGG CAT CCT GAT 1020
 321 E   A   K   D   V   F   L   G   M   F   L   Y   E   Y   A   R   R   H   P   D   340

                                  .           .           .           .           .
1021 TAC TCT GTC GTG CTG CTG CTG AGA CTT GCC AAG ACA TAT GAA ACC ACT CTA GAG AAG TGC 1080
 341 Y   S   V   V   L   L   L   R   L   A   K   T   Y   E   T   T   L   E   K   C   360

                                  .           .           .           .           .
1081 TGT GCC GCT GCA GAT CCT CAT GAA TGC TAT GCC AAA GTG TTC GAT GAA TTT AAA CCT CTT 1140
 361 C   A   A   A   D   P   H   E   C   Y   A   K   V   F   D   E   F   K   P   L   380

                                  .           .           .           .           .
1141 GTG GAA GAG CCT CAG AAT TTA ATC AAA CAA AAC TGT GAG CTT TTT GAG CAG CTT GGA GAG 1200
 381 V   E   E   P   Q   N   L   I   K   Q   N   C   E   L   F   E   Q   L   G   E   400

                                  .           .           .           .           .
1201 TAC AAA TTC CAG AAT GCG CTA TTA GTT CGT TAC ACC AAG AAA GTA CCC CAA GTG TCA ACT 1260
 401 Y   K   F   Q   N   A   L   L   V   R   Y   T   K   K   V   P   Q   V   S   T   420

                                  .           .           .           .           .
1261 CCA ACT CTT GTA GAG GTC TCA AGA AAC CTA GGA AAA GTG GGC AGC AAA TGT TGT AAA CAT 1320
 421 P   T   L   V   E   V   S   R   N   L   G   K   V   G   S   K   C   C   K   H   440

                                  .           .           .           .           .
1321 CCT GAA GCA AAA AGA ATG CCC TGT GCA GAA GAC TAT CTA TCC GTG GTC CTG AAC CAG TTA 1380
 441 P   E   A   K   R   M   P   C   A   E   D   Y   L   S   V   V   L   N   Q   L   460

                                  .           .           .           .           .
1381 TGT GTG TTG CAT GAG AAA ACG CCA GTA AGT GAC AGA GTC ACA AAA TGC TGC ACA GAG TCC 1440
 461 C   V   L   H   E   K   T   P   V   S   D   R   V   T   K   C   C   T   E   S   480
```

Figure 1C

```
1441 TTG GTG AAC AGG CGA CCA TGC TTT TCA GCT CTG GAA GTC GAT GAA ACA TAC GTT CCC AAA 1500
 481 L   V   N   R   R   P   C   F   S   A   L   E   V   D   E   T   Y   V   P   K   500

1501 GAG TTT AAT GCT GAA ACA TTC ACC TTC CAT GCA GAT ATA TGC ACA CTT TCT GAG AAG GAG 1560
 501 E   F   N   A   E   T   F   T   F   H   A   D   I   C   T   L   S   E   K   E   520

1561 AGA CAA ATC AAG AAA CAA ACT GCA CTT GTT GAG CTT GTG AAA CAC AAG CCC AAG GCA ACA 1620
 521 R   Q   I   K   K   Q   T   A   L   V   E   L   V   K   H   K   P   K   A   T   540

1621 AAA GAG CAA CTG AAA GCT GTT ATG GAT GAT TTC GCA GCT TTT GTA GAG AAG TGC TGC AAG 1680
 541 K   E   Q   L   K   A   V   M   D   D   F   A   A   F   V   E   K   C   C   K   560

1681 GCT GAC GAT AAG GAG ACC TGC TTT GCC GAG GAG GGT AAA AAA CTT GTT GCT GCA AGT CAA 1740
 561 A   D   D   K   E   T   C   F   A   E   E   G   K   K   L   V   A   A   S   Q   580

1741 GCT GCC TTA GGC TTA TAA CAT CTA CAT TTA AAA GCA TCT CAG 1782
 581 A   A   L   G   L   *                                   585
```

Figure 1D

ALBUMIN FUSION PROTEINS

CROSS-REFERENCE OF RELATED APPLICATIONS

This application claims benefit under 35 U.S.C. §119(e) based on U.S. Provisional Patent Application Ser. No. 60/811,405, filed Jun. 7, 2006. The above mentioned Provisional, patent application is incorporated by reference herein in its entirety.

STATEMENT UNDER 37 C.F.R. §1.77(b)(5)

This application refers to a "Sequence Listing" listed below, which is provided as a text document. The document is entitled "PF618_SeqListing.txt" (1,076,432 bytes, created Jun. 7, 2007), and is hereby incorporated by reference in its entirety herein.

BACKGROUND OF THE INVENTION

The invention relates generally to Therapeutic proteins (including, but not limited to, at least one polypeptide, antibody, peptide, or fragment and variant thereof) fused to albumin or fragments or variants of albumin. The invention encompasses polynucleotides encoding therapeutic albumin fusion proteins, therapeutic albumin fusion proteins, compositions, pharmaceutical compositions, formulations and kits. Host cells transformed with the polynucleotides encoding therapeutic albumin fusion proteins are also encompassed by the invention, as are methods of making the albumin fusion proteins of the invention using these polynucleotides, and/or host cells.

Human serum albumin (HSA, or HA), a protein of 585 amino acids in its mature form (as shown in FIG. 1 (SEQ ID NO:1)), is responsible for a significant proportion of the osmotic pressure of serum and also functions as a carrier of endogenous and exogenous ligands. At present, HA for clinical use is produced by extraction from human blood. The production of recombinant HA (rHA) in microorganisms has been disclosed in EP 330 451 and EP 361 991.

Therapeutic proteins in their native state or when recombinantly produced, such as interferons and growth hormones, are typically labile molecules exhibiting short shelf-lives, particularly when formulated in aqueous solutions. The instability in these molecules when formulated for administration dictates that many of the molecules must be lyophilized and refrigerated at all times during storage, thereby rendering the molecules difficult to transport and/or store. Storage problems are particularly acute when pharmaceutical formulations must be stored and dispensed outside of the hospital environment.

Few practical solutions to the storage problems of labile protein molecules have been proposed. Accordingly, there is a need for stabilized, long lasting formulations of proteinaceous therapeutic molecules that are easily dispensed, preferably with a simple formulation requiring minimal post-storage manipulation.

Upon in vivo administration, therapeutic proteins in their native state or when recombinantly produced, such as interferons and growth hormones, exhibit a short plasma stability due to rapid clearance from the bloodstream. Accordingly, the therapeutic effects provided by these proteins are also short-lived. Thus, in order to sustain their desired therapeutic effect in vivo, the rapid clearance of these proteins from the blood dictates that the therapeutic molecules must be administered more frequently or at a higher dose. However, increasing the dosing schedule for administration of the therapeutic protein often results in an increase in injection site reactions, side-effects, and toxicity in the patient. Similarly, administration of the therapeutic protein at a higher dose also commonly results in an increase in toxicity and side-effects in the patient.

The few practical solutions to increasing plasma stability of therapeutic molecules that have been proposed, including chemical conjugation, have provided limited benefit to the patient. Generally, in most cases, these chemically modified therapeutic molecules are still administered on a frequent dosing schedule, retaining significant injection site reactions, side-effects, and toxicity in patients. Accordingly, there is a need for an stabilized form of therapeutic molecules that retains a higher plasma stability in vivo than the native or recombinantly produced therapeutic alone and can be administered less frequently, thereby decreasing potential side-effects to the patient.

SUMMARY OF THE INVENTION

The present invention encompasses albumin fusion proteins comprising a Therapeutic protein (e.g., a polypeptide, antibody, or peptide, or fragment or variant thereof) fused to albumin or a fragment (portion) or variant of albumin. The present invention also encompasses polynucleotides comprising, or alternatively consisting of, nucleic acid molecules encoding a Therapeutic protein (e.g., a polypeptide, antibody, or peptide, or fragment or variant thereof) fused to albumin or a fragment (portion) or variant of albumin. The present invention also encompasses polynucleotides, comprising, or alternatively consisting of, nucleic acid molecules encoding proteins comprising a Therapeutic protein (e.g., a polypeptide, antibody, or peptide, or fragment or variant thereof) fused to albumin or a fragment (portion) or variant of albumin, that is sufficient to prolong the shelf life of the Therapeutic protein, to increase the plasma stability of the Therapeutic protein compared to its unfused state, and/or stabilize the Therapeutic protein and/or its activity in solution (or in a pharmaceutical composition) in vitro and/or in vivo. Albumin fusion proteins encoded by a polynucleotide of the invention are also encompassed by the invention, as are host cells transformed with polynucleotides of the invention, and methods of making the albumin fusion proteins of the invention and using these polynucleotides of the invention, and/or host cells.

In a preferred aspect of the invention, albumin fusion proteins include, but are not limited to, those described in Table 2 and the polynucleotides encoding such proteins.

The invention also encompasses pharmaceutical formulations comprising an albumin fusion protein of the invention and a pharmaceutically acceptable diluent or carrier. Such formulations may be in a kit or container. Such kit or container may be packaged with instructions pertaining to the extended shelf life of the Therapeutic protein. Such formulations may be used in methods of treating, preventing, ameliorating or diagnosing a disease or disease symptom in a patient, preferably a mammal, most preferably a human, comprising the step of administering the pharmaceutical formulation to the patient.

In other embodiments, the present invention encompasses methods of preventing, treating, or ameliorating a disease or disorder. In preferred embodiments, the present invention encompasses a method of treating a disease or disorder listed in the "Preferred Indication: Y" column of Table 1 comprising administering to a patient in which such treatment, prevention or amelioration is desired an albumin fusion protein of the invention that comprises a Therapeutic protein or portion corresponding to a Therapeutic protein (or fragment or variant thereof) disclosed in the "Therapeutic Protein: X" column of Table 1 (in the same row as the disease or disorder to be treated as listed in the "Preferred Indication: Y" column of Table 1) in an amount effective to treat, prevent or ameliorate the disease or disorder.

In one embodiment, an albumin fusion protein described in Table 1 or 2 has extended shelf life.

In a second embodiment, an albumin fusion protein described in Table 1 or 2 is more stable than the corresponding unfused Therapeutic molecule described in Table 1.

The present invention further includes transgenic organisms modified to contain the nucleic acid molecules of the invention (including, but not limited to, the polynucleotides described in Tables 1 and 2), preferably modified to express an albumin fusion protein of the invention.

BRIEF DESCRIPTION OF THE FIGURES

FIG. 1A-D shows the amino acid sequence of the mature form of human albumin (SEQ ID NO:1) and a polynucleotide encoding it (SEQ ID NO:2). Nucleotides 1 to 1755 of SEQ ID NO:2 encode the mature form of human albumin (SEQ ID NO:1).

DETAILED DESCRIPTION

Definitions

Figure 2:
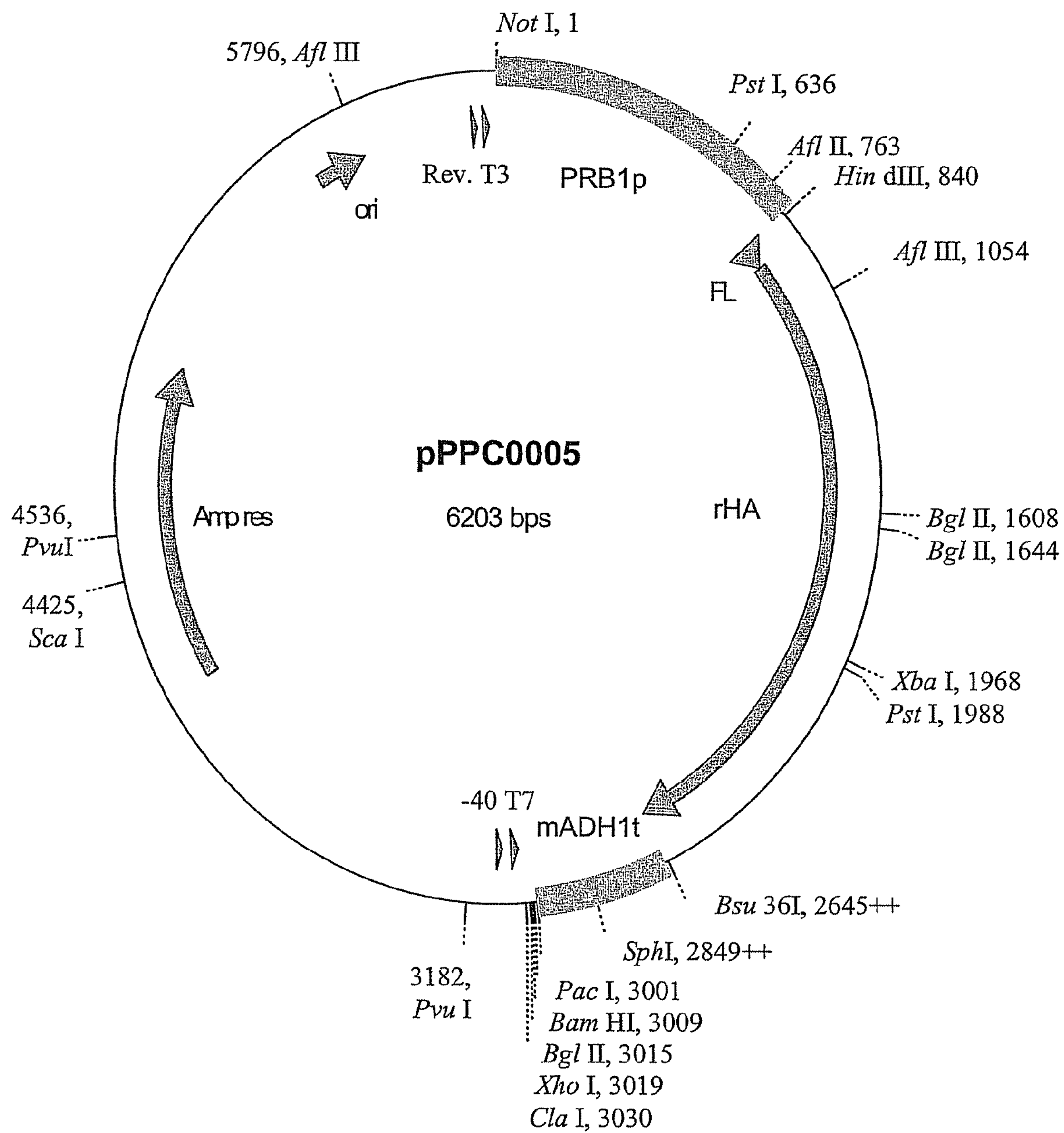
FIG. 2 shows the restriction map of the pPPC0005 cloning vector ATCC™ deposit PTA-3278.

The following definitions are provided to facilitate understanding of certain terms used throughout this specification.

As used herein, "polynucleotide" refers to a nucleic acid molecule having a nucleotide sequence encoding a fusion protein comprising, or alternatively consisting of, at least one molecule of albumin (or a fragment or variant thereof) joined in frame to at least one Therapeutic protein X (or fragment or variant thereof); a nucleic acid molecule having a nucleotide sequence encoding a fusion protein comprising, or alternatively consisting of, the amino acid sequence of SEQ ID NO:Y (as described in column 6 of Table 2) or a fragment or variant thereof; a nucleic acid molecule having a nucleotide sequence comprising or alternatively consisting of the sequence shown in SEQ ID NO:X; a nucleic acid molecule having a nucleotide sequence encoding a fusion protein comprising, or alternatively consisting of, the amino acid sequence of SEQ ID NO:Z; a nucleic acid molecule having a nucleotide sequence encoding an albumin fusion protein of the invention generated as described in Table 2 or in the Examples; a nucleic acid molecule having a nucleotide sequence encoding a Therapeutic albumin fusion protein of the invention, a nucleic acid molecule having a nucleotide sequence contained in an albumin fusion construct described in Table 2, or a nucleic acid molecule having a nucleotide sequence contained in an albumin fusion construct deposited with the ATCC™ (as described in Table 3).

As used herein, "albumin fusion construct" refers to a nucleic acid molecule comprising, or alternatively consisting of, a polynucleotide encoding at least one molecule of albumin (or a fragment or variant thereof) joined in frame to at least one polynucleotide encoding at least one molecule of a Therapeutic protein (or fragment or variant thereof); a nucleic acid molecule comprising, or alternatively consisting of, a polynucleotide encoding at least one molecule of albumin (or a fragment or variant thereof) joined in frame to at least one polynucleotide encoding at least one molecule of a Therapeutic protein (or fragment or variant thereof) generated as described in Table 2 or in the Examples; or a nucleic acid molecule comprising, or alternatively consisting of, a polynucleotide encoding at least one molecule of albumin (or a fragment or variant thereof) joined in frame to at least one polynucleotide encoding at least one molecule of a Therapeutic protein (or fragment or variant thereof), further comprising, for example, one or more of the following elements: (1) a functional self-replicating vector (including but not limited to, a shuttle vector, an expression vector, an integration vector, and/or a replication system), (2) a region for initiation of transcription (e.g., a promoter region, such as for example, a regulatable or inducible promoter, a constitutive promoter), (3) a region for termination of transcription, (4) a leader sequence, and (5) a selectable marker. The polynucleotide encoding the Therapeutic protein and albumin protein, once part of the albumin fusion construct, may each be referred to as a "portion," "region" or "moiety" of the albumin fusion construct.

The present invention relates generally to polynucleotides encoding albumin fusion proteins; albumin fusion proteins; and methods of treating, preventing, or ameliorating diseases or disorders using albumin fusion proteins or polynucleotides encoding albumin fusion proteins. As used herein, "albumin fusion protein" refers to a protein formed by the fusion of at least one molecule of albumin (or a fragment or variant thereof) to at least one molecule of a Therapeutic protein (or fragment or variant thereof). An albumin fusion protein of the invention comprises at least a fragment or variant of a Therapeutic protein and at least a fragment or variant of human serum albumin, which are associated with one another by genetic fusion (i.e., the albumin fusion protein is generated by translation of a nucleic acid in which a polynucleotide encoding all or a portion of a Therapeutic protein is joined in-frame with a polynucleotide encoding all or a portion of albumin). The Therapeutic protein and albumin protein, once part of the albumin fusion protein, may each be referred to as a "portion", "region" or "moiety" of the albumin fusion protein (e.g., a "Therapeutic protein portion" or an "albumin protein portion"). In a highly preferred embodiment, an albumin fusion protein of the invention comprises at least one molecule of a Therapeutic protein X or fragment or variant of thereof (including, but not limited to a mature form of the Therapeutic protein X) and at least one molecule of albumin or fragment or variant thereof (including but not limited to a mature form of albumin).

In a further preferred embodiment, an albumin fusion protein of the invention is processed by a host cell and secreted into the surrounding culture medium. Processing of the nascent albumin fusion protein that occurs in the secretory pathways of the host used for expression may include, but is not limited to signal peptide cleavage; formation of disulfide bonds; proper folding; addition and processing of carbohydrates (such as for example, N- and O-linked glycosylation); specific proteolytic cleavages; and assembly into multimeric proteins. An albumin fusion protein of the invention is preferably in the processed form. In a most preferred embodiment, the "processed form of an albumin fusion protein" refers to an albumin fusion protein product which has undergone N-terminal signal peptide cleavage, herein also referred to as a "mature albumin fusion protein".

In several instances, a representative clone containing an albumin fusion construct of the invention was deposited with the American Type Culture Collection (herein referred to as "ATCC™"). Furthermore, it is possible to retrieve a given albumin fusion construct from the deposit by techniques known in the art and described elsewhere herein. The ATCC™ is located at 10801 University Boulevard, Manassas, Va. 20110-2209, USA. The ATCC™ deposits were made pursuant to the terms of the Budapest Treaty on the international recognition of the deposit of microorganisms for the purposes of patent procedure.

In one embodiment, the invention provides a polynucleotide encoding an albumin fusion protein comprising, or alternatively consisting of, a Therapeutic protein and a serum albumin protein. In a further embodiment, the invention provides an albumin fusion protein comprising, or alternatively consisting of, a Therapeutic protein and a serum albumin protein. In a preferred embodiment, the invention provides an albumin fusion protein comprising, or alternatively consisting of, a Therapeutic protein and a serum albumin protein encoded by a polynucleotide described in Table 2. In a further preferred embodiment, the invention provides a polynucleotide encoding an albumin fusion protein whose sequence is shown as SEQ ID NO:Y in Table 2. In other embodiments, the invention provides an albumin fusion protein comprising, or alternatively consisting of, a biologically active and/or therapeutically active fragment of a Therapeutic protein and a serum albumin protein. In other embodiments, the invention provides an albumin fusion protein comprising, or alternatively consisting of, a biologically active and/or therapeutically active variant of a Therapeutic protein and a serum albumin protein. In preferred embodiments, the serum albumin protein component of the albumin fusion protein is the mature portion of serum albumin. The invention further encompasses polynucleotides encoding these albumin fusion proteins.

In further embodiments, the invention provides an albumin fusion protein comprising, or alternatively consisting of, a Therapeutic protein, and a biologically active and/or therapeutically active fragment of serum albumin. In further embodiments, the invention provides an albumin fusion protein comprising, or alternatively consisting of, a Therapeutic protein and a biologically active and/or therapeutically active variant of serum albumin. In preferred embodiments, the Therapeutic protein portion of the albumin fusion protein is the mature portion of the Therapeutic protein. In a further preferred embodiment, the Therapeutic protein portion of the albumin fusion protein is the extracellular soluble domain of the Therapeutic protein. In an alternative embodiment, the Therapeutic protein portion of the albumin fusion protein is the active form of the Therapeutic protein. The invention further encompasses polynucleotides encoding these albumin fusion proteins.

In further embodiments, the invention provides an albumin fusion protein comprising, or alternatively consisting of, a biologically active and/or therapeutically active fragment or variant of a Therapeutic protein and a biologically active and/or therapeutically active fragment or variant of serum albumin. In preferred embodiments, the invention provides an albumin fusion protein comprising, or alternatively consisting of, the mature portion of a Therapeutic protein and the mature portion of serum albumin. The invention further encompasses polynucleotides encoding these albumin fusion proteins.

Therapeutic Proteins

As stated above, a polynucleotide of the invention encodes a protein comprising or alternatively consisting of, at least a fragment or variant of a Therapeutic protein and at least a fragment or variant of human serum albumin, which are associated with one another, preferably by genetic fusion.

An additional embodiment includes a polynucleotide encoding a protein comprising or alternatively consisting of at least a fragment or variant of a Therapeutic protein and at least a fragment or variant of human serum albumin, which are linked with one another by chemical conjugation.

As used herein, "Therapeutic protein" refers to proteins, polypeptides, antibodies, peptides or fragments or variants thereof, having one or more therapeutic and/or biological activities. Therapeutic proteins encompassed by the invention include but are not limited to, proteins, polypeptides, peptides, antibodies, and biologics. (The terms peptides, proteins, and polypeptides are used interchangeably herein.) It is specifically contemplated that the term "Therapeutic protein" encompasses antibodies and fragments and variants thereof. Thus a protein of the invention may contain at least a fragment or variant of a Therapeutic protein, and/or at least a fragment or variant of an antibody. Additionally, the term "Therapeutic protein" may refer to the endogenous or naturally occurring correlate of a Therapeutic protein.

By a polypeptide displaying a "therapeutic activity" or a protein that is "therapeutically active" is meant a polypeptide that possesses one or more known biological and/or therapeutic activities associated with a therapeutic protein such as one or more of the Therapeutic proteins described herein or otherwise known in the art. As a non-limiting example, a "Therapeutic protein" is a protein that is useful to treat, prevent or ameliorate a disease, condition or disorder. As a non-limiting example, a "Therapeutic protein" may be one that binds specifically to a particular cell type (normal (e.g., lymphocytes) or abnormal e.g., (cancer cells)) and therefore may be used to target a compound (drug, or cytotoxic agent) to that cell type specifically.

For example, a non-exhaustive list of "Therapeutic protein" portions which may be comprised by an albumin fusion protein of the invention includes, but is not limited to, oxyntomodulin, CGRP, IGF-1, butyrylcholinesterase, somatostatin-28, urocortin I, urocortin II, glucocerebrosidase, glucagon, and phenylalanine hydroxylase.

In another non-limiting example, a "Therapeutic protein" is a protein that has a biological activity, and in particular, a biological activity that is useful for treating, preventing or ameliorating a disease. A non-inclusive list of biological activities that may be possessed by a Therapeutic protein includes, inhibition of HIV-1 infection of cells, stimulation of intestinal epithelial cell proliferation, reducing intestinal epithelial cell permeability, stimulating insulin secretion, induction of bronchodilation and vasodilation, inhibition of aldosterone and renin secretion, blood pressure regulation, promoting neuronal growth, enhancing an immune response, enhancing inflammation, suppression of appetite, or any one or more of the biological activities described in the "Biological Activities" section below and/or as disclosed for a given Therapeutic protein in Table 1 (column 2).

As used herein, "therapeutic activity" or "activity" may refer to an activity whose effect is consistent with a desirable therapeutic outcome in humans, or to desired effects in non-human mammals or in other species or organisms. Therapeutic activity may be measured in vivo or in vitro. For example, a desirable effect may be assayed in cell culture. Such in vitro or cell culture assays are commonly available for many Therapeutic proteins as described in the art. Examples of assays include, but are not limited to those described herein in the Examples section or in the "Exemplary Activity Assay" column (column 3) of Table 1.

Therapeutic proteins corresponding to a Therapeutic protein portion of an albumin fusion protein of the invention, such as cell surface and secretory proteins, are often modified by the attachment of one or more oligosaccharide groups. The modification, referred to as glycosylation, can dramatically affect the physical properties of proteins and can be important in protein stability, secretion, and localization. Glycosylation occurs at specific locations along the polypeptide backbone. There are usually two major types of glycosylation: glycosylation characterized by O-linked oligosaccharides, which are attached to serine or threonine residues; and glycosylation characterized by N-linked oligosaccharides, which are attached to asparagine residues in an Asn-X-Ser or Asn-X-Thr sequence, where X can be any amino acid except proline. N-acetylneuramic acid (also known as sialic acid) is usually the terminal residue of both N-linked and O-linked oligosaccharides. Variables such as protein structure and cell type influence the number and nature of the carbohydrate units within the chains at different glycosylation sites. Glycosylation isomers are also common at the same site within a given cell type.

Therapeutic proteins corresponding to a Therapeutic protein portion of an albumin fusion protein of the invention, as well as analogs and variants thereof, may be modified so that glycosylation at one or more sites is altered as a result of manipulation(s) of their nucleic acid sequence, by the host cell in which they are expressed, or due to other conditions of their expression. For example, glycosylation isomers may be produced by abolishing or introducing glycosylation sites, e.g., by substitution or deletion of amino acid residues, such as substitution of glutamine for asparagine, or unglycosylated recombinant proteins may be produced by expressing the proteins in host cells that will not glycosylate them, e.g. in *E. coli* or glycosylation-deficient yeast. These approaches are described in more detail below and are known in the art.

Therapeutic proteins, particularly those disclosed in Table 1, and their nucleic acid and amino acid sequences are well known in the art and available in public databases such as Chemical Abstracts Services Databases (e.g., the CAS Registry), GenBank, and subscription provided databases such as GenSeq (e.g., Derwent). Exemplary nucleotide sequences of Therapeutic proteins which may be used to derive a polynucleotide of the invention are shown in column 7, "SEQ ID NO:X," of Table 2. Sequences shown as SEQ ID NO:X may be a wild type polynucleotide sequence encoding a given Therapeutic protein (e.g., either full length or mature), or in some instances the sequence may be a variant of said wild type polynucleotide sequence (e.g., a polynucleotide which encodes the wild type Therapeutic protein, wherein the DNA sequence of said polynucleotide has been optimized, for example, for expression in a particular species; or a polynucleotide encoding a variant of the wild type Therapeutic protein (i.e., a site directed mutant; an allelic variant)). It is well within the ability of the skilled artisan to use the sequence shown as SEQ ID NO:X to derive the construct described in the same row. For example, if SEQ ID NO:X corresponds to a full length protein, but only a portion of that protein is used to generate the specific CID, it is within the skill of the art to rely on molecular biology techniques, such as PCR, to amplify the specific fragment and clone it into the appropriate vector.

Additional Therapeutic proteins corresponding to a Therapeutic protein portion of an albumin fusion protein of the invention include, but are not limited to, one or more of the Therapeutic proteins or peptides disclosed in the "Therapeutic Protein X" column of Table 1 (column 1), or fragment or variant thereof.

Table 1 provides a non-exhaustive list of Therapeutic proteins that correspond to a Therapeutic protein portion of an albumin fusion protein of the invention, or an albumin fusion protein encoded by a polynucleotide of the invention. The first column, "Therapeutic Protein X," discloses Therapeutic protein molecules that may be followed by parentheses containing scientific and brand names of proteins that comprise, or alternatively consist of, that Therapeutic protein molecule or a fragment or variant thereof. "Therapeutic protein X" as used herein may refer either to an individual Therapeutic protein molecule, or to the entire group of Therapeutic proteins associated with a given Therapeutic protein molecule disclosed in this column. The "Biological activity" column (column 2) describes Biological activities associated with the Therapeutic protein molecule. Column 3, "Exemplary Activity Assay," provides references that describe assays which may be used to test the therapeutic and/or biological activity of a Therapeutic protein:X or an albumin fusion protein comprising a Therapeutic protein X (or fragment thereof) portion. Each of the references cited in the "Exemplary Activity Assay" column are herein incorporated by reference in their entireties, particularly with respect to the description of the respective activity assay described in the reference (see Methods section therein, for example) for assaying the corresponding biological activity set forth in the "Biological Activity" column of Table 1. The fourth column, "Preferred Indication: Y," describes disease, disorders, and/or conditions that may be treated, prevented, diagnosed, and/or ameliorated by Therapeutic protein X or an albumin fusion protein comprising a Therapeutic protein X (or fragment thereof) portion. The "Construct ID" column (column 5) provides a link to an exemplary albumin fusion construct disclosed in Table 2 which encodes an albumin fusion protein comprising, or alternatively consisting of the referenced Therapeutic Protein X (or fragment thereof) portion.

TABLE 1

| Therapeutic Protein: X | Biological Activity | Exemplary Activity Assay |
|---|---|---|
| Oxyntomodulin | Stimulates insulin secretion; stimulates cAMP production; inhibits meal-stimulated gastric acid secretion; regulates gut motility; inhibits food intake. | The effect of oxyntomodulin on insulin secretion can be measured by methods known in the art, including the MIN6 cell assay described in Ann. NY Acad. Sci. 805: 44-51 (1996). cAMP accumulation can be measured using methods known in the art, including the in vitro assay described in Br J Pharmacol 138(4): 660-70 (2003). |
| Calcitonin gene-related peptide (CGRP) | CGRP is a potent vasodilator, and a regulator of endothelial and | The vasodilatory activity of CGRP can be assayed using the aortic ring vasodilation assay described in |

TABLE 1-continued

| | | |
|---|---|---|
| | osteoblast cell proliferation. Additional effects of CGRP include reduced gastric secretion, increased body temperature, anorexic effects, and positive inotropic and chronotropic effects on the heart | Pharmacol Res. 1999 Mar; 39(3): 217-20. Endothelial and osteoblast cell proliferation activities can be measured in vitro (Eur J Pharmacol. 2000 Dec 15; 409(3): 273-8; Proc Natl Acad Sci U S A 1990 May; 87(9): 3299-303) |
| Insulin-like growth factor-1 (Mecasermin; Somazon; IGF-1; IGF-1 complex; CEP 151; CGP 35126; FK 780; Mecar; RHIGF-I; Somatomedin-1; Somatomedin-C; SOMATOKINE; MYOTROPHIN; IGEF; DepoIGF-1) | IGF-I is a pleiotropic polypeptide with a wide range of actions in both central and peripheral nervous sytems. It is involved in growth and development and protects neurons against cell death via the activation of intracellular pathways implicating phosphatidylinositide 3/Akt kinase. | IGF-I activity may be assayed in vitro using an serum withdrawal apoptosis-protection assay. (J Endocrinol 2000 Oct; 167(1): 165-74). Proliferation assay using breast carcinoma cell line MCF-7 (Karey 1988 Cancer Res. 48: 4083) |
| Butyrylcholinesterase (BchE, Serum Cholinesterase, pseuocholinesterase E1 (CHE1)) | Butyrylcholinesterase accelerates cocaine metabolism: in vitro and in vivo effects in nonhuman primates and humans. Carmona GN, Jufer RA, Goldberg SR, Gorelick DA, Greig NH, Yu QS, Cone EJ, Schindler CW. Drug Metab Dispos. 2000 Mar; 28(3): 367-71. An atypical form of butyrylcholinesterase or the absence of its activity leads to prolonged apnea following administration of the muscle relaxant suxamethonium. The widespread expression of CHE1 in early differentiation suggests development-related functions for this protein. | BchE activity assay "Differential inhibition of human serum cholinesterase with fluoride: recognition of two new phenotypes." Nature 191: 496-498, 1961. "A rare genetically determined variant of pseudocholinesterase in two German families with high plasma enzyme activity." Europ. J. Biochem. 99: 65-69, 1979. "Genetic analysis of a Japanese patient with butyrylcholinesterase deficiency." Ann. Hum. Genet. 61: 491-496, 1997. |
| Somatostatin-28 (SST-28; SMST-28) | Inhibits growth hormone, glucagons and insulin; Suppresses LF response to GnRH; Decreases splanchnic blood flow; Inhibits release of serotonin, gastrin, vasoactive intestinal peptide, secretin, motilin, and pancreatic polypeptide. | Inhibition of growth hormone release in humans by somatostatin can be measured as described in J. Clin. Endocrinol. Metab. (1973) Oct; 37(4): 632-4. Inhibition of insulin secretion by somatostatin can be measured as described in the Lancet (1973) Dec. 8; 2(7841): 1299-1301. |
| Urocortin I (UCN; UI, UROC) | Acts as a natural agonist of the Type 2 Corticotropin-Releasing Factor Receptor. Engagement of this receptor by Urocortin I results in elevation of intracellular cAMP. | Elevation of intracellular cAMP can be measured by ELISA techniques well known in the art. |
| Urocortin II (UCN2; stresscopin-related peptide (SRP); urocortin-related peptide (URP); UCN-II) | Acts as a natural agonist of the Type 2 Corticotropin-Releasing Factor Receptor. Engagement of this receptor by Urocortin I I results in elevation of intracellular cAMP. | Elevation of intracellular cAMP can be measured by ELISA techniques well known in the art. |
| Glucocerebrosidase (GBA; Lysosomal glucocerebrosidase; Alglucerase; β-glucocerebrosidase; β-D-glucosyl-N-acylsphingosine glucohyrdolase; Glucosylceramidase; acid β-glucosidase; | Catalyzes the hydrolysis of D-glucosyl-N-acylsphingosine to D-glucose and N-acylsphingosine, catalyzes the hydrolysis of glucocerebroside to glucose ceramide | Enzymatic activity can be assessed using methods known in the art, for example, the thin-layer chromatography assay described by Poulos et al., Clin. Chim. Acta. 1976 Nov; 72(3): 327-335; or the FACS method described by Rudensky et al., Blood Cells Mol. Dis. 2003 Jan-Feb; 30(1): 97-99. |

TABLE 1-continued

| | | |
|---|---|---|
| Imiglucerase; CEREDASE; CEREZYME) (GCB)) | | |
| Glucagon (Glucagon; Insulinotropin; GLUCAGON; GLUCAGEN; GCG) | Induces hyperglycemia; stimulates conversion of glycogen to glucose; relaxes gastrointestinal smooth muscle cells. | Glucagon activity may be assayed in vitro using a [3-H]-glucose uptake assay. (J Biol Chem 1999 Oct 22; 274(43): 30864-30873). |
| Phenylalanine hydroxylase (PAH; PKU, PKU1; amino acid hydroxylase) | Converts phenylalanine to tyrosine; deficiency of PAH results in elevated blood levels of phenylalanine, causing mental retardation, microcephaly, delayed speech, seizures, eczema, behavior abnormalities, and other symptoms. | PAH activity may be assayed using assays well-known in the art, for example, by mixing the enzyme with phenylalanine and measuring tyrosine under appropriate conditions or by HPLC or colormetric assays known in the art. (Nutr Rev. 1969 Oct; 27(10): 297-9.) |

| Therapeutic Protein: X | Preferred Indication: Y | Construct ID | Therapeutic Protein: Z |
|---|---|---|---|
| Oxyntomodulin | Most preferred: Hyperglycemia; Obesity; Diabetes; Diabetes Insipidus; Diabetes mellitus; Type 1 diabetes; Type 2 diabetes; Insulin resistance; Insulin deficiency; Hyperlipidemia; Hyperketonemia; Non-insulin dependent Diabetes Mellitus (NIDDM); Insulin-dependent Diabetes Mellitus (IDDM); A Condition Associated With Diabetes Including, But Not Limited To Obesity, Heart Disease, Hyperglycemia, Infections, Retinopathy, And/Or Ulcers; Metabolic Disorders; Immune Disorders; Obesity; Vascular Disorders; Suppression of Body Weight; Suppression of Appetite; Syndrome X. | 3579, 3580, 4213, 4215, 4217, 4232, 4240, 4253, 4282, 4284, 4286, 4388, 4390, 4392, 4398, 4400, 4409, 4411, 4456, 4462, 4466, 4478. | See, Table 2, SEQ ID NO: Z for particular construct |
| Calcitonin gene-related peptide (CGRP) | Migraine Headaches; Angina Pectoris; Arrythmias; Heart Failure; Hypertension; Postmenopausal Osteoporosis; Raynaud's Disease; Subarachnoid Haemorrhage | 4246, 4247, 4248, 4249, 4378, 4379, 4380, 4381, 4382, 4383. | See Table 2, SEQ ID NO: Z for particular construct. |
| Insulin-like growth factor-1 (Mecasermin; Somazon; IGF-1; IGF-1 complex; CEP 151; CGP 35126; FK 780; Mecar; RHIGF-I; Somatomedin-1; Somatomedin-C; SOMATOKINE; MYOTROPHIN; IGEF; DepoIGF-1) | Diabetes mellitus; Growth disorders; Frailty; Amyotrophic lateral sclerosis; Osteoarthritis; Kidney disease & neuropathy; Dwarfism; HIV-1 infections; Myocardial ischaemia; Osteoporosis; Multiple sclerosis; Nerve disorders; Burns; diabetes; peripheral neuropathies | 4251, 4252, 4353, 4354. | See Table 2, SEQ ID NO: Z for particular construct. |
| Butyrylcholinesterase (BchE, Serum Cholinesterase, pseuocholinesterase E1 (CHE1)) | Detoxification for Cocaine Overdose; suxamethonium sensitivity; apnea; | 4258, 4259, 4312, 4331, 4333, 4358, 4384, 4385, 4386, 4401, 4402, 4403, 4404, 4412, 4413, 4414, 4418, 4419, 4457. | See Table 2, SEQ ID NO: Z for particular construct. |
| Somatostatin-28 (SST-28; SMST-28) | Cancer; Metastatic carcinoid tumors; Vasoactive Intestinal Peptide secreting adenomas; Diarrhea and Flushing; Prostatic disorders and cancers; Breast cancer; Gastrointestinal disorders and cancers; Cancers of the endocrine system; Head and neck paragangliomas; Liver disorders and cancers; Nasopharyngeal cancers; Thyroid disorders and cancers; Acromegaly; Carcinoid Syndrome; | 4298, 4299. | See Table 2, SEQ ID NO: Z for particular construct. |

TABLE 1-continued

| | | | |
|---|---|---|---|
| | Gallbladder disorders, such as gallbladder contractility diseases and abnormal bile secretion; Psoriasis; Diabetes; Diabetes Insipidus; Diabetes mellitus; Type 1 diabetes; Type 2 diabetes; Insulin resistance; Insulin deficiency; Hyperlipidemia; Hyperketonemia; Non-insulin dependent Diabetes Mellitus (NIDDM); Insulin-dependent Diabetes Mellitus (IDDM); A Condition Associated With Diabetes Including, But Not Limited To Obesity, Heart Disease, Hyperglycemia, Infections, Retinopathy, And/Or Ulcers; Metabolic Disorders; Immune Disorders; Obesity; Vascular Disorders; Suppression of Body Weight; Suppression of Appetite; Syndrome X; Kidney disorders; Neurological disorders and diseases, including Alzheimers Disease, Parkinson's disease and dementia; Neuropsychotic disorders, including Bipolar affective disorder; Rheumatoid arthritis; Hypertension; Intracranial hypertension; Esophageal varices; Graves' disease; Seizures; Epilepsy; Gastritis; Angiogenesis. | | |
| Urocortin I (UCN; UI, UROC) | Diabetes, obesity, congestive heart failure. | 4319, 4320, 4321, 4322, 4337, 4338, 4341, 4342. | See Table 2, SEQ ID NO: Z for particular construct. |
| Urocortin II (UCN2; stresscopin-related peptide (SRP); urocortin-related peptide (URP); UCN-II) | Diabetes, obesity, congestive heart failure. | 4323, 4324, 4325, 4326, 4339, 4340, 4343, 4344. | See Table 2, SEQ ID NO: Z for particular construct. |
| Glucocerebrosidase (GBA; Lysosomal glucocerebrosidase; Alglucerase; β-glucocerebrosidase; β-D-glucosyl-N-acylsphingosine glucohyrdolase; Glucosylceramidase; acid β-glucosidase; Imiglucerase; CEREDASE; CEREZYME) (GCB)) | Gaucher disease, lysosomal storage diseases | 3920, 3921, 3922, 3923, 4347, 4348, 4393, 4394, 4395, 4396, 4406, 4424. | See Table 2, SEQ ID NO: Z for particular construct. |
| Glucagon (Glucagon; Insulinotropin; GLUCAGON; GLUCAGEN; GCG) | Hypoglycemia; Diabetes; Diabetes Insipidus; Diabetes mellitus; Type 1 diabetes; Type 2 diabetes; Insulin resistance; Insulin deficiency; Hyperlipidemia; Hyperketonemia; Non-insulin dependent Diabetes Mellitus (NIDDM); Insulin-dependent Diabetes Mellitus (IDDM); A Condition Associated With Diabetes Including, But Not Limited To Obesity, Heart Disease, Hyperglycemia, Infections, Retinopathy, And/Or Ulcers; Metabolic Disorders; Immune Disorders; Obesity; Vascular Disorders; Suppression of Body Weight; Suppression of Appetite; Syndrome X; Endocrine disorders. | 4427, 4429, 4431, 4453, 4455,. | See Table 2, SEQ ID NO: Z for particular construct. |
| Phenylalanine hydroxylase (PAH; PKU, PKU1; amino acid hydroxylase) | Phenylketonuria; hyperphenylalaninemia; tardive dyskinesia, diseases of cysteine metabolism, any disease or disorder where the metabolism of phenylalanine or cysteine could be beneficial | 4447, 4458, 4459, 4460, 4461, 4463, 4467, 4468, 4469, 4470, 4471, 4472, 4473, 4474. | See Table 2, SEQ ID NO: Z for particular construct. |

TABLE 2

| Fusion No. | Construct ID | Construct Name | Description | Expression Vector | SEQ ID NO: Y | SEQ ID NO: X | SEQ ID NO: Z | SEQ ID NO: A | SEQ ID NO: B | Leader Sequence |
|---|---|---|---|---|---|---|---|---|---|---|
| 1 | 4213 | pSAC35:INVsp.OXM.HSA | Invertase signal sequence followed by full-length oxyntomodulin fused to the N-terminus of HSA. | pSAC35 | 119 | 105 | 133 | None | None | Invertase |
| 2 | 4215 | pSAC35:INVsp.PYY3-36.HSA(D25-E40).HSA.OXM | Invertase signal sequence followed by PYY (amino acids 3-36) fused via a 16 amino acid linker from HSA (amino acids 25-40) to the N-terminus of mature HSA which is fused at its C-terminus to full-length oxyntomodulin. | pSAC35 | 120 | 106 | 134 | 147 | 148 | Invertase |
| 3 | 4217 | pC4:HSA.OXM | Pre-pro region of the HSA signal sequence followed by mature HSA fused at its C-terminus to full-length oxyntomodulin. | pC4 (Mammalian) | 121 | 107 | 135 | 149 | 150 | HSA |
| 4 | 4232 | pCDNA3.1+:HSA.OXM | Pre-pro region of the HSA signal sequence followed by mature HSA fused at its C-terminus to full length oxyntomodulin. | pCDNA3.1+ | 122 | 108 | 136 | None | None | HSA |
| 5 | 4240 | pC4: SPCON2sp.OXM.HSA | A consensus signal sequence followed by oxynotmodulin fused to the N-terminus of mature HSA. | pC4 (Mammalian) | 123 | 109 | 137 | None | None | Consensus |
| 6 | 4246 | pSAC35:CGRP(V8-F37).HSA | HSA/Kex-2 signal sequence followed by a truncated form of CGRP (amino acids 8-37) fused to the N-terminus of mature HSA. | pSAC35 | 124 | 110 | 138 | None | None | HSA/Kex-2 |
| 7 | 4247 | pSAC35:HSA.CGRP(V8-F37) | HSA/Kex-2 signal sequence followed by mature HSA fused to a truncated form of CGRP (amino acids 8-37) at its C-terminus. | pSAC35 | 125 | 111 | 139 | None | None | HSA/Kex-2 |
| 8 | 4248 | pSAC35:CGRP(L12-F37).HSA | HSA/Kex-2 signal sequence followed by a truncated form of CGRP (amino acids 12-37) fused to the N-terminus of mature HSA. | pSAC35 | 126 | 112 | 140 | None | None | HSA/Kex-2 |
| 9 | 4249 | pSAC35:HSA.CGRP(L12-F37) | HSA/Kex-2 signal sequence followed by a mature HSA fused to a truncated form of CGRP (amino acids 12-37) at its C-terminus. | pSAC35 | 127 | 113 | 141 | None | None | HSA/Kex-2 |
| 10 | 4251 | pSAC35:HSA.IGF1(G49-M153) | HSA/Kex-2 signal sequence followed by mature HSA fused to a mature form of IGF1 (amino acids 49-153) at its C-terminus. | pSAC35 | 128 | 114 | 142 | None | None | HSA/Kex-2 |
| 11 | 4252 | pSAC35:IGF1(G49-M153).HSA | HSA/Kex-2 signal sequence followed by a mature form of IGF1 (amino acids 49-153) fused to the N-terminus of mature HSA. | pSAC35 | 129 | 115 | 143 | None | None | HSA/Kex-2 |
| 12 | 4253 | pC4:SPCON2.OXM.OXM.HSA | A consensus signal sequence followed by two tandem copies of oxyntomodulin fused to the N-terminus of mature HSA. | pC4 (Mammalian) | 130 | 116 | 144 | None | None | Consensus |
| 13 | 4258 | pSAC35.BChE(E29-V557).HSA | HSA/Kex-2 signal sequence followed by butyrylcholinesterase (BChE) (amino acids 39-529 (A356W, Y360A, N45Q, N483Q, N509Q and N514Q)) fused to the N-terminus of mature HSA. | pSAC35 | 131 | 117 | 145 | None | None | HSA/Kex-2 |
| 14 | 4259 | pC4:SPCON2.BChE(E29-V557).HSA | A consensus signal sequence followed by butyrylcholinesterase (BChE) (amino acids 39-529 (A356W, Y360A, N45Q, N483Q, N509Q and N514Q)) fused to the N-terminus of mature HSA. | pC4 (Mammalian) | 132 | 118 | 146 | None | None | Consensus |
| 15 | 3579 | pSAC35:HSA/kex2.HSA.oxyntomodulin | HSA/kex2 leader followed by mature HSA followed by mature oxyntomodulin. | pSAC35 | 153 | 151 | 155 | None | None | HSA/kex2 |

TABLE 2-continued

| Fusion No. | Construct ID | Construct Name | Description | Expression Vector | SEQ ID NO: Y | SEQ ID NO: X | SEQ ID NO: Z | SEQ ID NO: A | SEQ ID NO: B | Leader Sequence |
|---|---|---|---|---|---|---|---|---|---|---|
| 16 | 3580 | pSAC35:HSA/kex2.oxyntomodulin. HSA | HSA/kex2 leader followed by mature oxyntomodulin followed by mature HSA. | pSAC35 | 154 | 152 | 156 | None | None | HSA/kex2 |
| 17 | 3920 | pSAC35:HSA/Kex2-GCB.HSA | HSA/KEX-2 signal sequence followed by lysosomal glucocerebrosidase fused to the N-terminus of mature HSA. | pSAC35 | 161 | 157 | 165 | None | None | HSA/Kex2 |
| 18 | 3921 | pC4:SPCON-GCB.HSA | A consensus signal sequence followed by lysosomal glucocerebrosidase fused to the N-terminus of mature HSA. | pC4 (Mammalian) | 162 | 158 | 166 | None | None | Consensus |
| 19 | 3922 | pSAC35:HSA/Kex2-HSA.GCB | HSA/KEX-2 signal sequence followed by mature HSA fused to the N-terminus of lysosomal glucocerebrosidase. | pSAC35 | 163 | 159 | 167 | None | None | HSA/Kex2 |
| 20 | 3923 | pC4:HSA/Kex2-HSA.GCB | HSA/KEX-2 signal sequence followed by mature HSA fused to the N-terminus of lysosomal glucocerebrosidase. | pC4 (Mammalian) | 164 | 160 | 168 | None | None | HSA/Kex2 |
| 21 | 4282 | pSAC35: INVsp.OXM.OXM.HSA | Invertase signal sequence followed by two tandem full-length oxyntomodulin fused to the N-terminus of mature HSA. | pSAC35 | 251 | 169 | 333 | None | None | Invertase |
| 22 | 4284 | pSAC35: [HSA/Kex(R19G)]sp.OXM. OXM.HSA | Modified HSA/kex2 signal sequence followed by two tandem full-length oxyntomodulin fused to the N-terminus of mature HSA. | pSAC35 | 252 | 170 | 334 | None | None | Modified HSA/Kex2 |
| 23 | 4286 | pSAC35: [HSA/Kex(R19G)]sp.OXM. HSA | Modified HSA/kex2 signal sequence followed by full-length oxyntomodulin fused to the N-terminus of mature HSA. | pSAC35 | 253 | 171 | 335 | None | None | Modified HSA/Kex2 |
| 24 | 4298 | pSAC35:Somatostatin-28:HSA | HSA/kex2 signal sequence followed by mature somatostatin-28 fused to the N-terminus of mature HSA. | pSAC007 (CEC) | 254 | 172 | 336 | 415 | 416 | HSA/Kex2 |
| 25 | 4299 | pSAC35:HSA:Somatostatin-28 | HSA/kex2 signal sequence followed by mature HSA fused at its C-terminus to mature somatostatin-28. | pSAC009 (NEC) | 255 | 173 | 337 | 417 | 418 | HSA/Kex2 |
| 26 | 4312 | pSAC35.BChE(E29-V529) (A328W, Y332A).HSA | HSA/Kex-2 signal sequence followed by mature butyrylcholinesterase (BChE) lacking the C-terminal tetramerization domain (A328W, Y332A)) fused to the N-terminus of mature HSA. | pSAC35 | 256 | 174 | 338 | None | None | HSA/Kex2 |
| 27 | 4319 | pc4:HSA.Urocortin I | Pre-pro region of the HSA signal sequence followed by mature HSA fused at its C-terminus to full-length urocortin I. | pC4 (Mammalian) | 257 | 175 | 339 | 419 | 420 | HSA |
| 28 | 4320 | pc4:HSA.2x.Urocortin I | Pre-pro region of the HSA signal sequence followed by mature HSA fused at its C-terminus to two tandem full-length urocortin I. | pC4 (Mammalian) | 258 | 176 | 340 | None | None | HSA |
| 29 | 4321 | pc4:Urocortin I.HSA | Pre-pro region of the HSA signal sequence followed by full-length urocortin I fused to the N-terminus of mature HSA. | pC4 (Mammalian) | 259 | 177 | 341 | 421 | 422 | HSA |
| 30 | 4322 | pc4:2x.Urocortin I.HSA | Pre-pro region of the HSA signal sequence followed by two tandem full-length urocortin I fused to the N-terminus of mature HSA | pC4 (Mammalian) | 260 | 178 | 342 | 423 | 424 | HSA |
| 31 | 4323 | pc4:HSA.Urocortin II | Pre-pro region of the HSA signal sequence followed by mature HSA fused at its C-terminus to full-length urocortin II. | pC4 (Mammalian) | 261 | 179 | 343 | None | None | HSA |
| 32 | 4324 | pc4:HSA.2x.Urocortin II | Pre-pro region of the HSA signal sequence followed by mature HSA fused at it C-terminus to two tandem | pC4 (Mammalian) | 262 | 180 | 344 | None | None | HSA |

TABLE 2-continued

| Fusion No. | Construct ID | Construct Name | Description | Expression Vector | SEQ ID NO: Y | SEQ ID NO: X | SEQ ID NO: Z | SEQ ID NO: A | SEQ ID NO: B | Leader Sequence |
|---|---|---|---|---|---|---|---|---|---|---|
| | | | full-length urocortin II. | | | | | | | |
| 33 | 4325 | pc4:Urocortin II.HSA | Pre-pro region of the HSA signal sequence followed by full-length urocortin II fused to the N-terminus of mature HSA. | pC4 (Mammalian) | 263 | 181 | 345 | 425 | 426 | HSA |
| 34 | 4326 | pc4:2x.Urocortin II.HSA | Pre-pro region of the HSA signal sequence followed by two tandem full-length urocortin II fused to the N-terminus of mature HSA. | pC4 (Mammalian) | 264 | 182 | 346 | 427 | 428 | HSA |
| 35 | 4331 | pC4: HSA.BChE(E29-V529) (A328W, Y332A) | Pre-pro region of the HSA signal sequence followed by mature HSA fused at its C-terminus to mature butyrylcholinesterase (BChE) lacking the C-terminal tetramerization domain (A328W, Y332A)). | pC4 (Mammalian) | 265 | 183 | 347 | 429 | 430 | HSA |
| 36 | 4333 | pSAC35: HSA.BChE(E29-V529) (A328W, Y332A) | HSA/Kex-2 signal sequence followed by mature HSA fused at its C-terminus to mature butyrylcholinesterase (BChE) lacking the C-terminal tetramerization domain (A328W, Y332A)). | pSAC35 | 266 | 184 | 348 | None | None | HSA/Kex2 |
| 37 | 4337 | pSAC35:HSA.UrocortinI | HSA/Kex-2 signal sequence followed by mature HSA fused at its C-terminus to full-length urocortin I. | pSAC35 | 267 | 185 | 349 | None | None | HSA/Kex2 |
| 38 | 4338 | pSAC35:HSA.2X.UrocortinI | HSA/Kex-2 signal sequence followed by mature HSA fused at its C-terminus to two tandem full-length urocortin I. | pSAC35 | 268 | 186 | 350 | None | None | HSA/Kex2 |
| 39 | 4339 | pSAC35:HSA.UrocortinII | HSA/Kex-2 signal sequence followed by mature HSA fused at its C-terminus to full-length urocortin II. | pSAC35 | 269 | 187 | 351 | None | None | HSA/Kex2 |
| 40 | 4340 | pSAC35:HSA.2X.UrocortinII | HSA/Kex-2 signal sequence followed by mature HSA fused at its C-terminus to two tandem full-length urocortin II. | pSAC35 | 270 | 188 | 352 | None | None | HSA/Kex2 |
| 41 | 4341 | pSAC35:KEX2.UrocortinI. HSA | HSA/Kex-2 signal sequence followed by full-length urocortin II fused to the N-terminus of mature HSA. | pSAC35 | 271 | 189 | 353 | None | None | HSA/Kex2 |
| 42 | 4342 | pSAC35:KEX2.2X.UrocortinI. HSA | HSA/Kex-2 signal sequence followed by two tandem full-length urocortin I fused to the N-terminus of mature HSA. | pSAC35 | 272 | 190 | 354 | None | None | HSA/Kex2 |
| 43 | 4343 | pSAC35:KEX2.UrocortinII. HSA | HSA/Kex-2 signal sequence followed by full-length urocortin II fused to the N-terminus of mature HSA. | pSAC35 | 273 | 191 | 355 | None | None | HSA/Kex2 |
| 44 | 4344 | pSAC35:KEX2.2X.UrocortinII. HSA | HSA/Kex-2 signal sequence followed by two tandem full-length urocortin II fused to the N-terminus of mature HSA. | pSAC35 | 274 | 192 | 356 | None | None | HSA/Kex2 |
| 45 | 4347 | pC4:HSA.GBA | Pre-pro region of HSA signal sequence followed by mature HSA fused at its C-terminus to mature glucocerebrosidase (GBA). | pC4 (Mammalian) | 275 | 193 | 357 | 431 | 432 | HSA |
| 46 | 4348 | pC4:GBA.A39-Q497.HSA | A consensus signal sequence followed by mature GBA fused to the N-terminus of mature HSA. | pC4 (Mammalian) | 276 | 194 | 358 | 433 | 434 | Consensus |
| 47 | 4353 | pC4:IGF1.G49-A118.HSA | Pre-pro region of the HSA signal sequence followed by a truncated form of IGF1 (amino acids 49-118) fused to the N-terminus of mature HSA. | pC4 (Mammalian) | 277 | 195 | 359 | 435 | 436 | HSA |
| 48 | 4354 | pC4:HSA.IGF1.G49-A118 | Pre-pro region of the HSA signal sequence followed by mature HSA fused at its C-terminus to a truncated form of IGF1 (amino acids 49-118) | pC4 (Mammalian) | 278 | 196 | 360 | 437 | 438 | HSA |
| 49 | 4358 | pC4:SPCON2.BChE(E29-V529). | A consensus signal sequence followed by mature | pC4 | 279 | 197 | 361 | None | None | Consensus |

TABLE 2-continued

| Fusion No. | Construct ID | Construct Name | Description | Expression Vector | SEQ ID NO: Y | SEQ ID NO: X | SEQ ID NO: Z | SEQ ID NO: A | SEQ ID NO: B | Leader Sequence |
|---|---|---|---|---|---|---|---|---|---|---|
| | | HSA | butyrylcholinesterase (BChE) lacking the C-terminal tetramerization domain fused to the N-terminus of mature HSA | (Mammalian) | | | | | | |
| 50 | 4378 | pC4: SPCON2.CGRP(V8-F37).HSA | A consensus signal sequence followed by a truncated form of CGRP (amino acids 8-37) fused to the N-terminus of mature HSA. | pC4 (Mammalian) | 280 | 198 | 362 | 439 | 440 | Consensus |
| 51 | 4379 | pC4: SPCON2.CGRP(L12-F37).HSA | A consensus signal sequence followed by a truncated form of CGRP (amino acids 12-37) fused to the N-terminus of mature HSA. | pC4 (Mammalian) | 281 | 199 | 363 | 441 | 442 | Consensus |
| 52 | 4380 | pC4: HSA.CGRP(V8-F37) | HSA/Kex-2 signal sequence followed by mature HSA fused at its C-terminus to a truncated form of CGRP (amino acids 8-37). | pC4 (Mammalian) | 282 | 200 | 364 | 443 | 444 | HSA/Kex2 |
| 53 | 4381 | pC4: HSA.CGRP(L12-F37) | HSA/Kex-2 signal sequence followed by mature HSA fused at its C-terminus to a truncated form of CGRP (amino acids 12-37). | pC4 (Mammalian) | 283 | 201 | 365 | 445 | 446 | HSA/Kex2 |
| 54 | 4382 | pC4: HSA.CGRP(V8-G38) | HSA/Kex-2 signal sequence followed by mature HSA fused at its C-terminus to a glycine extended truncated form of CGRP (amino acids 8-38). | pC4 (Mammalian) | 284 | 202 | 366 | 447 | 448 | HSA/Kex2 |
| 55 | 4383 | pC4: HSA.CGRP(L12-G38) | HSA/Kex-2 signal sequence followed by mature HSA fused at its C-terminus to a glycine extended truncated form of CGRP (amino acids 12-38). | pc4HSA | 285 | 203 | 367 | 449 | 450 | HSA/Kex2 |
| 56 | 4384 | pEE12: SPCON2.BChE(E29-V529)(A328W, Y332A).HSA | A consensus signal sequence followed by mature butyrylcholinesterase (BChE) lacking the C-terminal tetramerization domain (A328W, Y332A)) fused to the N-terminus of mature HSA. | pEE12.1 | 286 | 204 | 368 | None | None | Consensus |
| 57 | 4385 | pEE12.HSA.BChE(E29-V529)(A328W, Y332A) | Pre-pro region of the HSA signal sequence followed by mature HSA fused at its C-terminus to mature butyrylcholinesterase (BChE) lacking the C-terminal tetramerization domain (A328W, Y332A)). | pEE12.1 | 287 | 205 | 369 | None | None | HSA |
| 59 | 4386 | pEE12:SPCON2.BChE(E29-V529).HSA | A consensus signal sequence followed by mature butyrylcholinesterase (BChE) lacking the C-terminal tetramerization domain fused to the N-terminus of mature HSA. | pEE12.1 | 288 | 206 | 370 | None | None | Consensus |
| 60 | 4388 | pSAC35: [HSA/Kex(R19G)]sp.OXM (H1-K30).HSA | Modified HSA/kex2 signal sequence followed by a truncated form of OXM (amino acids 1-30) fused to the N-terminus of mature HSA. | pSAC35 | 289 | 207 | 371 | None | None | Modified HSA/Kex2 |
| 61 | 4390 | pSAC35: [HSA/Kex(R19G)]sp.OXM (H1-K30)(R18A).HSA | Modified HSA/kex2 signal sequence followed by a mutant truncated form of OXM (amino acids 1-30) (R18A) fused to the N-terminus of mature HSA. | pSAC35 | 290 | 208 | 372 | None | None | Modified HSA/Kex2 |
| 62 | 4392 | pSAC35: [HSA/Kex(R19G)]sp.OXM (H1-A37)(R18A).HSA | Modified HSA/kex2 signal sequence followed by a mutated full-length OXM (R18A) fused to the N-terminus of mature HSA. | pSAC35 | 291 | 209 | 373 | None | None | Modified HSA/Kex2 |
| 63 | 4393 | pSAC35: GBA.HSA | Modified HSA/kex2 signal sequence followed by mature GBA fused to the N-terminus of mature HSA. | pSAC35 | 292 | 210 | 374 | None | None | Modified HSA/Kex2 |
| 64 | 4394 | NEC: HSA.GBA (one step) | HSA/Kex-2 signal sequence followed by mature HSA fused at its C-terminus to mature GBA | pSAC009 (NEC) | 293 | 211 | 375 | 451 | 452 | HSA/Kex2 |
| 65 | 4395 | pEE12.1:GBA.A40-Q536.HSA | A consensus signal sequence followed by mature GBA fused to the N-terminus of mature HSA. | pEE12.1 | 294 | 212 | 376 | None | None | Consensus |

TABLE 2-continued

| Fusion No. | Construct ID | Construct Name | Description | Expression Vector | SEQ ID NO: Y | SEQ ID NO: X | SEQ ID NO: Z | SEQ ID NO: A | SEQ ID NO: B | Leader Sequence |
|---|---|---|---|---|---|---|---|---|---|---|
| 66 | 4396 | pEE12.1:HSA.GBA | Pre-pro region of the HSA signal sequence followed by mature HSA fused at its C-terminus to mature GBA. | pEE12.1 | 295 | 213 | 377 | None | None | Consensus |
| 67 | 4398 | pSAC35: [HSA/kex(R19G)]sp.OXM (H1-A37)(K30G).HSA | Modified HSA/kex2 signal sequence followed by a mutated full-length OXM (K30G) fused to the N-terminus of mature HSA. | pSAC35 | 296 | 214 | 378 | None | None | Modified HSA/Kex2 |
| 68 | 4400 | pSAC35: [HSA/kex(R19G)]sp.OXM (H1-K30)(2x).HSA | Modified HSA/kex2 signal sequence followed by two tandem truncated OXM (amino acids 1-30) fused to the N-terminus of mature HSA. | pSAC35 | 297 | 215 | 379 | None | None | Modified HSA/Kex2 |
| 69 | 4401 | pSAC35.HSA.ycoBChE(E29-V529) (9xNglyKO) | HSA/Kex-2 signal sequence followed by mature HSA fused at its C-terminus to a yeast codon optimized variant of mature BChE containing 9 N-linked glycosylation knock-outs and lacking the C-terminal tetramerization domain fused to the C-terminus of HSA. | pSAC35 | 298 | 216 | 380 | None | None | HSA/Kex2 |
| 70 | 4402 | pC4:SPCON2.BChE(E29-V529) (G117H).HSA | A consensus signal sequence followed by a mature BChE lacking the C-terminal tetramerization domain (G117H) fused to the N-terminus of mature HSA. | pC4 (Mammalian) | 299 | 217 | 381 | 453 | 454 | Consensus |
| 71 | 4403 | pC4: SPCON2.BChE(E29-V529) (A199S, S287G, A328W, Y332G).HSA | A consensus signal sequence followed by a mature BchE lacking the C-terminal tetramerization domain (A199S, S287G, A328W, Y332G) fused to the N-terminus of mature HSA. | pC4 (Mammalian) | 300 | 218 | 382 | 455 | 456 | Consensus |
| 72 | 4404 | pC4:SPCON2.BChE(E29-V529) (G117H, A199S, S287G, A328W, Y332G).HSA | A consensus signal sequence followed by a mature BChE lacking the C-terminal tetramerization domain (G117H, A199S, S287G, A328W, Y332G fused to the N-terminus of mature HSA. | pC4 (Mammalian) | 301 | 219 | 383 | 457 | 458 | Consensus |
| 73 | 4406 | pSAC35: HSA.GBA (two-step) | HSA/Kex-2 signal sequence followed by mature HSA fused at its C-terminus to mature GBA. | pSAC35 | 302 | 220 | 384 | None | None | HSA/Kex2 |
| 74 | 4409 | pSAC35: [HSA/Kex(R19G)]sp.OXM (H1-K30) (R18A)(2x).HSA | Modified HSA/kex2 signal sequence followed by two tandem truncated OXM mutants (amino acids 1-30 (R18A)) fused to the N-terminus of mature HSA. | pSAC35 | 303 | 221 | 385 | None | None | Modified HSA/Kex2 |
| 75 | 4411 | pSAC35: [HSA/Kex(R19G)]sp.OXM (H1-A37) (R18A, K30G).HSA | Modified HSA/kex2 signal sequence followed by a mutated form of full-length OXM (R18A, K30G) fused to the N-terminus of mature HSA. | pSAC35 | 304 | 222 | 386 | None | None | Modified HSA/Kex2 |
| 76 | 4412 | pEE12.1: SPCON2.BChE(E29-V529) (G117H).HSA | A consensus signal sequence followed by a mature BChE lacking the C-terminal tetramerization domain (G117H) fused to the N-terminus of mature HSA. | pEE12.1 | 305 | 223 | 387 | None | None | Consensus |
| 77 | 4413 | pEE12.1: SPCON2.BChE(E29-V557) (A227S, S315G, A356W, Y360G).HSA | A consensus signal sequence followed by a mature BChE lacking the C-terminal tetramerization domain (A227S, S315G, A356W, Y360G) fused to the N-terminus of mature HSA | pEE12.1 | 306 | 224 | 388 | None | None | Consensus |
| 78 | 4414 | pEE12.1: SPCON2.BChE(E29-V529) (G117H, A199S, S287G, A328W, Y332G).HSA | A consensus signal sequence followed by a mature BchE lacking the C-terminal tetramerization domain (G117H, A199S, S287G, A328W, Y332G) fused to the N-terminus of mature HSA. | pEE12.1 | 307 | 225 | 389 | None | None | Consensus |
| 79 | 4418 | pEE12.1: HSA.BChE(E29-V529) (G117H, A199S, S287G, | Pre-pro region of the HSA signal sequence followed by mature HSA fused at its C-terminus to mature | pEE12.1 | 308 | 226 | 390 | 459 | 460 | HSA |

TABLE 2-continued

| Fusion No. | Construct ID | Construct Name | Description | Expression Vector | SEQ ID NO: Y | SEQ ID NO: X | SEQ ID NO: Z | SEQ ID NO: A | SEQ ID NO: B | Leader Sequence |
|---|---|---|---|---|---|---|---|---|---|---|
| | | A328W, Y332G) | butyrylcholinesterase (BChE) lacking the C-terminal tetramerization domain (G117H, A199S, S287G, A328W, Y332G). | | | | | | | |
| 80 | 4419 | pSAC35.ycoHSA.ycoBChE (E29-V529)(9xNglyKO) | Modified HSA/kex2 signal sequence followed by a yeast codon optimized mature HSA (SEQ ID NO: 492) fused at its C-terminus to a yeast codon optimized variant of mature BChE containing 9 N-linked glycosylation knock-outs and lacking the C-terminal tetramerization domain. | pSAC35 | 309 | 227 | 391 | None | None | Modified HSA/Kex2 |
| 81 | 4424 | pc4: HSA.GBA.T74-G429 | Pre-pro region of the HSA signal sequence followed by mature HSA fused at its C-terminus to a N-terminally truncated form of GBA (amino acids 74-429). | pC4 (Mammalian) | 310 | 228 | 392 | 461 | 462 | HSA |
| 82 | 4427 | pSAC35: [HSA/Kex(R19G)]sp.GLU (H1-T29)(S16A).HSA | Modified HSA/kex2 signal sequence followed by a mutated form of full-length glucagons (GLU)(S16A) fused to the N-terminus of mature HSA. | pSAC35 | 311 | 229 | 393 | 463 | 464 | Modified HSA/Kex2 |
| 83 | 4429 | pSAC35: [HSA/Kex(R19G)]sp.GLU (H1-T29) (S16A, R18A).HSA | Modified HSA/kex2 signal sequence followed by a mutated form of full-length glucagon (GLU)(S16A, R18A) fused to the N-terminus of mature HSA. | pSAC35 | 312 | 230 | 394 | 465 | 466 | Modified HSA/Kex2 |
| 84 | 4431 | pSAC35: HSA.GLU(H1-T29) (S16A, R18A) | HSA/Kex-2 signal sequence followed by mature HSA fused at its C-terminus to a mutated form of glucagons (GLU)(S16A, R18A). | pSAC35 | 313 | 231 | 395 | 467 | 468 | HSA/Kex2 |
| 85 | 4447 | pSAC.PAH143-411.HSA | HSA/Kex-2 signal sequence followed by a truncated form of phenylalanine hydroxylase (PAH) (amino acids 143-411) fused to the N-terminus of mature HSA. | pSAC35 | 314 | 232 | 396 | None | None | HSA/Kex2 |
| 86 | 4453 | pSAC35: [HSA/Kex(R18G)]sp.GLU (S2-T29) (D9G, R18A).HSA | Modified HSA/kex2 signal sequence followed by an N-terminally truncated GLU mutant (amino acids 2-29)(D9G, R18A) fused to the N-terminus of mature HSA. | pSAC35 | 315 | 233 | 397 | 469 | 470 | Modified HSA/Kex2 |
| 87 | 4455 | pSAC35: HSA.GLU(S2-T29) (D9G, R18A) | HSA/Kex-2 signal sequence followed by mature HSA fused at its C-terminus to an N-terminally truncated GLU mutant (amino acids 2-29)(D9G, R18A). | pSAC35 | 316 | 234 | 398 | 471 | 472 | HSA/Kex2 |
| 88 | 4457 | pEE12.1: HSA.BChE(E29-V529) (A199S, S287G, A328W, Y332G) | Pre-pro region of the HSA signal sequence followed by mature HSA fused at its C-terminus to mature butyrylcholinesterase (BChE) lacking the C-terminal tetramerization domain (A199S, S287G, A328W, Y332G). | pEE12.1 | 317 | 235 | 399 | 473 | 474 | HSA |
| 89 | 4458 | pC4HSA:HSA:PAH102-428 | Pre-pro region of the HSA signal sequence followed by mature HSA fused at its C-terminus to a truncated form of PAH (amino acids 102-428). | pC4 (Mammalian) | 318 | 236 | 400 | 475 | 476 | HSA |
| 90 | 4459 | pC4HSA:PAH102-428:HSA | Pre-pro region of the HSA signal sequence followed by a truncated form of PAH (amino acids 102-428) fused to the N-terminus of mature HSA. | pC4 (Mammalian) | 319 | 237 | 401 | 477 | 478 | HSA |
| 91 | 4460 | pSAC009:HSA:PAH102-428 | HSA/Kex-2 signal sequence followed by mature HSA fused at its C-terminus to a truncated form of PAH (amino acids 102-428). | pSAC009 (NEC) | 320 | 238 | 402 | 479 | 480 | HSA?Kex2 |

TABLE 2-continued

| Fusion No. | Construct ID | Construct Name | Description | Expression Vector | SEQ ID NO: Y | SEQ ID NO: X | SEQ ID NO: Z | SEQ ID NO: A | SEQ ID NO: B | Leader Sequence |
|---|---|---|---|---|---|---|---|---|---|---|
| 92 | 4461 | pSAC007:PAH102-428:HSA | HSA/Kex-2 signal sequence followed by a truncated form of PAH (amino acids 102-428) fused to the N-terminus of mature HSA. | pSAC007 (CEC) | 321 | 239 | 403 | 481 | 482 | HSA/Kex2 |
| 93 | 4463 | pC4.HSA.PAH.116-428 | Pre-pro region of the HSA signal sequence followed by mature HSA fused at its C-terminus to a truncated form of PAH (amino acids 116-428). | pC4 (Mammalian) | 322 | 240 | 404 | 483 | 484 | HSA |
| 94 | 4466 | pSAC35: [HSA/Kex(R19G)]sp.OXM (H1-A37)(R17Q, K30Q).GGGGGSY. HSA | Modified HSA/kex2 signal sequence followed by a full-length OXM (R17Q, K30Q) fused to the N-terminus of yeast codon optimized mature HSA via a gly-gly-gly-gly-gly-gly-ser-tyr linker. | pSAC35 | 323 | 241 | 405 | None | None | Modified HSA/kex2 |
| 95 | 4467 | pC4HSA:HSA:PAH1-428 | Pre-pro region of the HSA signal sequence followed by mature HSA fused at its C-terminus to a truncated form of PAH (amino acids 1-428) | pC4 (Mammalian) | 324 | 242 | 406 | None | None | HSA |
| 96 | 4468 | pC4HSA:PAH1-428:HSA | Pre-pro region of the HSA signal sequence followed by a truncated form of PAH (amino acids 1-428) fused to the N-terminus of mature HSA. | pC4 (Mammalian) | 325 | 243 | 407 | None | None | HSA |
| 97 | 4469 | pSAC009:HSA:PAH1-428 | HSA/Kex-2 signal sequence followed by mature HSA fused at its C-terminus to a truncated form of PAH (amino acids 1-428). | pSAC009 (NEC) | 326 | 244 | 408 | None | None | HSA/Kex2 |
| 98 | 4470 | pSAC007:PAH1-428:HSA | HSA/Kex-2 signal sequence followed by a truncated form of PAH (amino acids 1-428) fused at the N-terminus of mature HSA. | pSAC007 (CEC) | 327 | 245 | 409 | None | None | HSA/Kex2 |
| 99 | 4471 | pC4HSA:HSA:PAH102-452 | Pre-pro region of the HSA signal sequence followed by mature HSA fused at its C-terminus to a truncated form of PAH (amino acids 102-452). | pC4 (Mammalian) | 328 | 246 | 410 | None | None | HSA |
| 100 | 4472 | pC4HSA:PAH102-452:HSA | Pre-pro region of the HSA signal sequence followed by a truncated form of PAH (amino acids 102-452) fused at the N-terminus of mature HSA. | pC4 (Mammalian) | 329 | 247 | 411 | None | None | HSA |
| 101 | 4473 | pSAC009:HSA:PAH102-452 | HSA/Kex-2 signal sequence followed by mature HSA fused at its C-terminus to a truncated form of PAH (amino acids 102-452). | pSAC009 (NEC) | 330 | 248 | 412 | None | None | HSA/Kex2 |
| 102 | 4474 | pSAC007:PAH102-452:HSA | HSA/Kex-2 signal sequence followed by a truncated form of PAH (amino acids 102-453) fused at the N-terminus of mature HSA. | pSAC007 (CEC) | 331 | 249 | 413 | None | None | HSA/Kex2 |
| 103 | 4478 | pSAC35: [HSA/Kex(R19G)]sp.OXM (H1-A37)(R18A, K30G)(3x).HSA | Modified HSA/kex2 signal sequence followed by three tandem full-length OXM (R18A, K30G) fused to the N-terminus of mature HSA. | pSAC35 | 332 | 250 | 414 | None | None | Modified HSA/Kex2 |
| 104 | 4456 | pGAPZaB:alpha factor sp.OXM (H1-A37).HSA | Yeast mating factor alpha signal sequence followed by full-length OXM fused to the N-terminus of mature HSA. | pGAPZalphaB | 487 | 485 | 489 | None | None | MFα-1 |
| 105 | 4462 | pPICZa:alpha factor sp. OXM (H1-A37)x2.HSA | Yeast mating factor alpha signal sequence followed by two tandem full-length OXM fused to the N-terminus of HSA | pPICZa | 488 | 486 | 490 | None | None | MFα-1 |

Table 2 provides a non-exhaustive list of polynucleotides of the invention comprising, or alternatively consisting of, nucleic acid molecules encoding an albumin fusion protein. The first column, "Fusion No." gives a fusion number to each polynucleotide. Column 2, "Construct ID" provides a unique numerical identifier for each polynucleotide of the invention. The Construct IDs may be used to identify polynucleotides which encode albumin fusion proteins comprising, or alternatively consisting of, a Therapeutic protein portion corresponding to a given Therapeutic Protein:X listed in the corresponding row of Table 1 wherein that Construct ID is listed in column 5. The "Construct Name" column (column 3) provides the name of a given albumin fusion construct or polynucleotide.

The fourth column in Table 2, "Description" provides a general description of a given albumin fusion construct, and the fifth column, "Expression Vector" lists the vector into which a polynucleotide comprising, or alternatively consisting of, a nucleic acid molecule encoding a given albumin fusion protein was cloned. Vectors are known in the art, and are available commercially or described elsewhere. For example, as described in the Examples, an "expression cassette" comprising, or alternatively consisting of, one or more of (1) a polynucleotide encoding a given albumin fusion protein, (2) a leader sequence, (3) a promoter region, and (4) a transcriptional terminator, may be assembled in a convenient cloning vector and subsequently be moved into an alternative vector, such as, for example, an expression vector including, for example, a yeast expression vector or a mammalian expression vector. In one embodiment, for expression in *S. cervisiae*, an expression cassette comprising, or alternatively consisting of, a nucleic acid molecule encoding an albumin fusion protein is cloned into pSAC35. In another embodiment, for expression in CHO cells, an expression cassette comprising, or alternatively consisting of, a nucleic acid molecule encoding an albumin fusion protein is cloned into pC4. In a further embodiment, a polynucleotide comprising or alternatively consisting of a nucleic acid molecule encoding the Therapeutic protein portion of an albumin fusion protein is cloned into pC4:HSA. In a still further embodiment, for expression in NS0 cells, an expression cassette comprising, or alternatively consisting of, a nucleic acid molecule encoding an albumin fusion protein is cloned into pEE12. Other useful cloning and/or expression vectors will be known to the skilled artisan and are within the scope of the invention.

Column 6, "SEQ ID NO:Y," provides the full length amino acid sequence of the albumin fusion protein of the invention. In most instances, SEQ ID NO:Y shows the unprocessed form of the albumin fusion protein encoded in other words, SEQ ID NO:Y shows the signal sequence, a HSA portion, and a therapeutic portion all encoded by the particular construct. Specifically contemplated by the present invention are all polynucleotides that encode SEQ ID NO:Y. When these polynucleotides are used to express the encoded protein from a cell, the cell's natural secretion and processing steps produces a protein that lacks the signal sequence listed in columns 4 and/or 11 of Table 2. The specific amino acid sequence of the listed signal sequence is shown later in the specification or is well known in the art. Thus, most preferred embodiments of the present invention include the albumin fusion protein produced by a cell (which would lack the leader sequence shown in columns 4 and/or 11 of Table 2). Also most preferred are polypeptides comprising SEQ ID NO:Y without the specific leader sequence listed in columns 4 and/or 11 of Table 2. Compositions comprising these two preferred embodiments, including pharmaceutical compositions, are also preferred. Moreover, it is well within the ability of the skilled artisan to replace the signal sequence listed in columns 4 and/or 11 of Table 2 with a different signal sequence, such as those described later in the specification to facilitate secretion of the processed albumin fusion protein.

The seventh column, "SEQ ID NO:X," provides the parent nucleic acid sequence from which a polynucleotide encoding a Therapeutic protein portion of a given albumin fusion protein may be derived. In one embodiment, the parent nucleic acid sequence from which a polynucleotide encoding a Therapeutic protein portion of an albumin fusion protein may be derived comprises the wild type gene sequence encoding a Therapeutic protein shown in Table 1. In an alternative embodiment, the parent nucleic acid sequence from which a polynucleotide encoding a Therapeutic protein portion of an albumin fusion protein may be derived comprises a variant or derivative of a wild type gene sequence encoding a Therapeutic protein shown in Table 1, such as, for example, a synthetic codon optimized variant of a wild type gene sequence encoding a Therapeutic protein.

The eighth column, "SEQ ID NO:Z," provides a predicted translation of the parent nucleic acid sequence (SEQ ID NO:X). This parent sequence can be a full length parent protein used to derive the particular construct, the mature portion of a parent protein, a variant or fragment of a wildtype protein, or an artificial sequence that can be used to create the described construct. One of skill in the art can use this amino acid sequence shown in SEQ ID NO:Z to determine which amino acid residues of an albumin fusion protein encoded by a given construct are provided by the therapeutic protein. Moreover, it is well within the ability of the skilled artisan to use the sequence shown as SEQ ID NO:Z to derive the construct described in the same row. For example, if SEQ ID NO:Z corresponds to a full length protein, but only a portion of that protein is used to generate the specific CID, it is within the skill of the art to rely on molecular biology techniques, such as PCR, to amplify the specific fragment and clone it into the appropriate vector.

Amplification primers provided in columns 9 and 10, "SEQ ID NO:A" and "SEQ ID NO:B" respectively, are exemplary primers used to generate a polynucleotide comprising or alternatively consisting of a nucleic acid molecule encoding the Therapeutic protein portion of a given albumin fusion protein. In one embodiment of the invention, oligonucleotide primers having the sequences shown in columns 9 and/or 10 (SEQ ID NOS:A and/or B) are used to PCR amplify a polynucleotide encoding the Therapeutic protein portion of an albumin fusion protein using a nucleic acid molecule comprising or alternatively consisting of the nucleotide sequence provided in column 7 (SEQ ID NO:X) of the corresponding row as the template DNA. PCR methods are well-established in the art. Additional useful primer sequences could readily be envisioned and utilized by those of ordinary skill in the art.

In an alternative embodiment, oligonucleotide primers may be used in overlapping PCR reactions to generate mutations within a template DNA sequence. PCR methods are known in the art.

As shown in Table 3, certain albumin fusion constructs disclosed in this application have been deposited with the ATCC™

TABLE 3

| Construct ID | Construct Name | ATCC ™ Deposit No./ Date |
|---|---|---|
| | | |

It is possible to retrieve a given albumin fusion construct from the deposit by techniques known in the art and described elsewhere herein (see, Example 10). The ATCC™ is located at 10801 University Boulevard, Manassas, Va. 20110-2209, USA. The ATCC™ deposits were made pursuant to the terms of the Budapest Treaty on the international recognition of the deposit of microorganisms for the purposes of patent procedure.

In a further embodiment of the invention, an "expression cassette" comprising, or alternatively consisting of one or more of (1) a polynucleotide encoding a given albumin fusion protein, (2) a leader sequence, (3) a promoter region, and (4) a transcriptional terminator can be moved or "subcloned" from one vector into another. Fragments to be subcloned may be generated by methods well known in the art, such as, for example, PCR amplification (e.g., using oligonucleotide primers having the sequence shown in SEQ ID NO:A or B), and/or restriction enzyme digestion.

In preferred embodiments, the albumin fusion proteins of the invention are capable of a therapeutic activity and/or biologic activity corresponding to the therapeutic activity and/or biologic activity of the Therapeutic protein corresponding to the Therapeutic protein portion of the albumin fusion protein listed in the corresponding row of Table 1. In further preferred embodiments, the therapeutically active protein portions of the albumin fusion proteins of the invention are fragments or variants of the protein encoded by the sequence shown in SEQ ID NO:X column of Table 2, and are capable of the therapeutic activity and/or biologic activity of the corresponding Therapeutic protein.

Polypeptide and Polynucleotide Fragments and Variants

Fragments

The present invention is further directed to fragments of the Therapeutic proteins described in Table 1, albumin proteins, and/or albumin fusion proteins of the invention.

The present invention is also directed to polynucleotides encoding fragments of the Therapeutic proteins described in Table 1, albumin proteins, and/or albumin fusion proteins of the invention.

Even if deletion of one or more amino acids from the N-terminus of a protein results in modification or loss of one or more biological functions of the Therapeutic protein, albumin protein, and/or albumin fusion protein of the invention, other Therapeutic activities and/or functional activities (e.g., biological activities, ability to multimerize, ability to bind a ligand) may still be retained. For example, the ability of polypeptides with N-terminal deletions to induce and/or bind to antibodies which recognize the complete or mature forms of the polypeptides generally will be retained when less than the majority of the residues of the complete polypeptide are removed from the N-terminus. Whether a particular polypeptide lacking N-terminal residues of a complete polypeptide retains such immunologic activities can readily be determined by routine methods described herein and otherwise known in the art. It is not unlikely that a mutein with a large number of deleted N-terminal amino acid residues may retain some biological or immunogenic activities. In fact, peptides composed of as few as six amino acid residues may often evoke an immune response.

Accordingly, fragments of a Therapeutic protein corresponding to a Therapeutic protein portion of an albumin fusion protein of the invention, include the full length protein as well as polypeptides having one or more residues deleted from the amino terminus of the amino acid sequence of the reference polypeptide (i.e., a Therapeutic protein referred to in Table 1, or a Therapeutic protein portion of an albumin fusion protein encoded by a polynucleotide or albumin fusion construct described in Table 2). In particular, N-terminal deletions may be described by the general formula m to q, where q is a whole integer representing the total number of amino acid residues in a reference polypeptide (e.g., a Therapeutic protein referred to in Table 1, or a Therapeutic protein portion of an albumin fusion protein of the invention, or a Therapeutic protein portion of an albumin fusion protein encoded by a polynucleotide or albumin fusion construct described in Table 2), and m is defined as any integer ranging from 2 to q minus 6. Polynucleotides encoding these polypeptides are also encompassed by the invention.

In addition, fragments of serum albumin polypeptides corresponding to an albumin protein portion of an albumin fusion protein of the invention, include the full length protein as well as polypeptides having one or more residues deleted from the amino terminus of the amino acid sequence of the reference polypeptide (i.e., serum albumin, or a serum albumin portion of an albumin fusion protein encoded by a polynucleotide or albumin fusion construct described in Table 2). In preferred embodiments, N-terminal deletions may be described by the general formula m to 585, where 585 is a whole integer representing the total number of amino acid residues in mature human serum albumin (SEQ ID NO:1), and m is defined as any integer ranging from 2 to 579. Polynucleotides encoding these polypeptides are also encompassed by the invention. In additional embodiments, N-terminal deletions may be described by the general formula m to 609, where 609 is a whole integer representing the total number of amino acid residues in full length human serum albumin (SEQ ID NO:3), and m is defined as any integer ranging from 2 to 603. Polynucleotides encoding these polypeptides are also encompassed by the invention.

Moreover, fragments of albumin fusion proteins of the invention, include the full length albumin fusion protein as well as polypeptides having one or more residues deleted from the amino terminus of the albumin fusion protein (e.g., an albumin fusion protein encoded by a polynucleotide or albumin fusion construct described in Table 2; or an albumin fusion protein having the amino acid sequence disclosed in column 6 of Table 2). In particular, N-terminal deletions may be described by the general formula m to q, where q is a whole integer representing the total number of amino acid residues in the albumin fusion protein, and m is defined as any integer ranging from 2 to q minus 6. Polynucleotides encoding these polypeptides are also encompassed by the invention.

Also as mentioned above, even if deletion of one or more amino acids from the N-terminus or C-terminus of a reference polypeptide (e.g., a Therapeutic protein; serum albumin protein; or albumin fusion protein of the invention) results in modification or loss of one or more biological functions of the protein, other functional activities (e.g., biological activities, ability to multimerize, ability to bind a ligand) and/or Therapeutic activities may still be retained. For example the ability of polypeptides with C-terminal deletions to induce and/or bind to antibodies which recognize the complete or mature forms of the polypeptide generally will be retained when less than the majority of the residues of the complete or mature polypeptide are removed from the C-terminus. Whether a particular polypeptide lacking the N-terminal and/or C-terminal residues of a reference polypeptide retains Therapeutic activity can readily be determined by routine methods described herein and/or otherwise known in the art.

The present invention further provides polypeptides having one or more residues deleted from the carboxy terminus of the amino acid sequence of a Therapeutic protein corresponding to a Therapeutic protein portion of an albumin fusion protein of the invention (e.g., a Therapeutic protein referred to in Table 1, or a Therapeutic protein portion of an albumin fusion protein encoded by a polynucleotide or albumin fusion construct described in Table 2). In particular, C-terminal deletions may be described by the general formula 1 to n, where n is any whole integer ranging from 6 to q minus 1, and where q is a whole integer representing the total number of amino acid residues in a reference polypeptide (e.g., a Therapeutic protein referred to in Table 1, or a Therapeutic protein portion of an albumin fusion protein encoded by a polynucleotide or albumin fusion construct described in Table 2). Polynucleotides encoding these polypeptides are also encompassed by the invention.

In addition, the present invention provides polypeptides having one or more residues deleted from the carboxy terminus of the amino acid sequence of an albumin protein corresponding to an albumin protein portion of an albumin fusion protein of the invention (e.g., serum albumin or an albumin protein portion of an albumin fusion protein encoded by a polynucleotide or albumin fusion construct described in Table 2). In particular, C-terminal deletions may be described by the general formula 1 to n, where n is any whole integer ranging from 6 to 584, where 584 is the whole integer representing the total number of amino acid residues in mature human serum albumin (SEQ ID NO:1) minus 1. Polynucleotides encoding these polypeptides are also encompassed by the invention. In particular, C-terminal deletions may be described by the general formula 1 to n, where n is any whole integer ranging from 6 to 608, where 608 is the whole integer representing the total number of amino acid residues in serum albumin (SEQ ID NO:3) minus 1. Polynucleotides encoding these polypeptides are also encompassed by the invention.

Moreover, the present invention provides polypeptides having one or more residues deleted from the carboxy terminus of an albumin fusion protein of the invention. In particular, C-terminal deletions may be described by the general formula 1 to n, where n is any whole integer ranging from 6 to q minus 1, and where q is a whole integer representing the total number of amino acid residues in an albumin fusion protein of the invention. Polynucleotides encoding these polypeptides are also encompassed by the invention.

In addition, any of the above described N- or C-terminal deletions can be combined to produce a N- and C-terminal deleted reference polypeptide. The invention also provides polypeptides having one or more amino acids deleted from both the amino and the carboxyl termini, which may be described generally as having residues m to n of a reference polypeptide (e.g., a Therapeutic protein referred to in Table 1, or a Therapeutic protein portion of an albumin fusion protein of the invention, or a Therapeutic protein portion encoded by a polynucleotide or albumin fusion construct described in Table 2, or serum albumin (e.g., SEQ ID NO:1), or an albumin protein portion of an albumin fusion protein of the invention, or an albumin protein portion encoded by a polynucleotide or albumin fusion construct described in Table 2, or an albumin fusion protein, or an albumin fusion protein encoded by a polynucleotide or albumin fusion construct of the invention) where n and m are integers as described above. Polynucleotides encoding these polypeptides are also encompassed by the invention.

The present application is also directed to proteins containing polypeptides at least 80%, 85%, 90%, 95%, 96%, 97%, 98% or 99% identical to a reference polypeptide sequence (e.g., a Therapeutic protein referred to in Table 1, or a Therapeutic protein portion of an albumin fusion protein of the invention, or a Therapeutic protein portion encoded by a polynucleotide or albumin fusion construct described in Table 2, or serum albumin (e.g., SEQ ID NO: 1), or an albumin protein portion of an albumin fusion protein of the invention, or an albumin protein portion encoded by a polynucleotide or albumin fusion construct described in Table 2, or an albumin fusion protein, or an albumin fusion protein encoded by a polynucleotide or albumin fusion construct of the invention) set forth herein, or fragments thereof. In preferred embodiments, the application is directed to proteins comprising polypeptides at least 80%, 85%, 90%, 95%, 96%, 97%, 98% or 99% identical to reference polypeptides having the amino acid sequence of N- and C-terminal deletions as described above. Polynucleotides encoding these polypeptides are also encompassed by the invention.

Preferred polypeptide fragments of the invention are fragments comprising, or alternatively, consisting of, an amino acid sequence that displays a Therapeutic activity and/or functional activity (e.g. biological activity) of the polypeptide sequence of the Therapeutic protein or serum albumin protein of which the amino acid sequence is a fragment.

Other preferred polypeptide fragments are biologically active fragments. Biologically active fragments are those exhibiting activity similar, but not necessarily identical, to an activity of the polypeptide of the present invention. The biological activity of the fragments may include an improved desired activity, or a decreased undesirable activity.

Variants

"Variant" refers to a polynucleotide or nucleic acid differing from a reference nucleic acid or polypeptide, but retaining essential properties thereof. Generally, variants are overall closely similar, and, in many regions, identical to the reference nucleic acid or polypeptide.

As used herein, "variant", refers to a Therapeutic protein portion of an albumin fusion protein of the invention, albumin portion of an albumin fusion protein of the invention, or albumin fusion protein of the invention differing in sequence from a Therapeutic protein (e.g. see "therapeutic" column of Table 1), albumin protein, and/or albumin fusion protein, respectively, but retaining at least one functional and/or therapeutic property thereof as described elsewhere herein or otherwise known in the art. Generally, variants are overall very similar, and, in many regions, identical to the amino acid sequence of the Therapeutic protein corresponding to a Therapeutic protein portion of an albumin fusion protein, albumin protein corresponding to an albumin protein portion of an albumin fusion protein, and/or albumin fusion protein. Nucleic acids encoding these variants are also encompassed by the invention.

The present invention is also directed to proteins which comprise, or alternatively consist of, an amino acid sequence which is at least 80%, 85%, 90%, 95%, 96%, 97%, 98%, 99% or 100%, identical to, for example, the amino acid sequence of a Therapeutic protein corresponding to a Therapeutic protein portion of an albumin fusion protein of the invention (e.g., the amino acid sequence of a Therapeutic protein:X disclosed in Table 1; or the amino acid sequence of a Therapeutic protein portion of an albumin fusion protein encoded by a polynucleotide or albumin fusion construct described in Table 1 and 2, or fragments or variants thereof), albumin proteins corresponding to an albumin protein portion of an albumin fusion protein of the invention (e.g., the amino acid sequence of an albumin protein portion of an albumin fusion protein encoded by a polynucleotide or albumin fusion construct described in Table 1 and 2; the amino acid sequence shown in SEQ ID NO:1; or fragments or variants thereof), and/or albumin fusion proteins. Fragments of these polypeptides are also provided (e.g., those fragments described herein). Further polypeptides encompassed by the invention are polypeptides encoded by polynucleotides which hybridize to the complement of a nucleic acid molecule encoding an albumin fusion protein of the invention under stringent hybridization conditions (e.g., hybridization to filter bound DNA in 6× Sodium chloride/Sodium citrate (SSC) at about 45 degrees Celsius, followed by one or more washes in 0.2×SSC, 0.1% SDS at about 50-65 degrees Celsius), under highly stringent conditions (e.g., hybridization to filter bound DNA in 6× sodium chloride/Sodium citrate (SSC) at about 45 degrees Celsius, followed by one or more washes in 0.1×SSC, 0.2% SDS at about 68 degrees Celsius), or under other stringent hybridization conditions which are known to those of skill in the art (see, for example, Ausubel, F. M. et al., eds., 1989 *Current protocol in Molecular Biology*, Green publishing associates, Inc., and John Wiley & Sons Inc., New York, at pages 6.3.1-6.3.6 and 2.10.3). Polynucleotides encoding these polypeptides are also encompassed by the invention.

By a polypeptide having an amino acid sequence at least, for example, 95% "identical" to a query amino acid sequence, it is intended that the amino acid sequence of the subject polypeptide is identical to the query sequence except that the subject polypeptide sequence may include up to five amino acid alterations per each 100 amino acids of the query amino acid sequence. In other words, to obtain a polypeptide having an amino acid sequence at least 95% identical to a query amino acid sequence, up to 5% of the amino acid residues in the subject sequence may be inserted, deleted, or substituted with another amino acid. These alterations of the reference sequence may occur at the amino- or carboxy-terminal positions of the reference amino acid sequence or anywhere between those terminal positions, interspersed either individually among residues in the reference sequence or in one or more contiguous groups within the reference sequence.

As a practical matter, whether any particular polypeptide is at least 80%, 85%, 90%, 95%, 96%, 97%, 98% or 99% identical to, for instance, the amino acid sequence of an albumin fusion protein of the invention or a fragment thereof (such as a Therapeutic protein portion of the albumin fusion protein or an albumin portion of the albumin fusion protein), can be determined conventionally using known computer programs. A preferred method for determining the best overall match between a query sequence (a sequence of the present invention) and a subject sequence, also referred to as a global sequence alignment, can be determined using the FASTDB computer program based on the algorithm of Brutlag et al. (Comp. App. Biosci. 6:237-245 (1990)). In a sequence alignment the query and subject sequences are either both nucleotide sequences or both amino acid sequences. The result of said global sequence alignment is expressed as percent identity. Preferred parameters used in a FASTDB amino acid alignment are: Matrix=PAM 0, k-tuple=2, Mismatch Penalty=1, Joining Penalty=20, Randomization Group Length=0, Cutoff Score=1, Window Size=sequence length, Gap Penalty=5, Gap Size Penalty=0.05, Window Size=500 or the length of the subject amino acid sequence, whichever is shorter.

If the subject sequence is shorter than the query sequence due to N- or C-terminal deletions, not because of internal deletions, a manual correction must be made to the results. This is because the FASTDB program does not account for N- and C-terminal truncations of the subject sequence when calculating global percent identity. For subject sequences truncated at the N- and C-termini, relative to the query sequence, the percent identity is corrected by calculating the number of residues of the query sequence that are N- and C-terminal of the subject sequence, which are not matched/aligned with a corresponding subject residue, as a percent of the total bases of the query sequence. Whether a residue is matched/aligned is determined by results of the FASTDB sequence alignment. This percentage is then subtracted from the percent identity, calculated by the above FASTDB program using the specified parameters, to arrive at a final percent identity score. This final percent identity score is what is used for the purposes of the present invention. Only residues to the N- and C-termini of the subject sequence, which are not matched/aligned with the query sequence, are considered for the purposes of manually adjusting the percent identity score. That is, only query residue positions outside the farthest N- and C-terminal residues of the subject sequence.

For example, a 90 amino acid residue subject sequence is aligned with a 100 residue query sequence to determine percent identity. The deletion occurs at the N-terminus of the subject sequence and therefore, the FASTDB alignment does not show a matching/alignment of the first 10 residues at the N-terminus. The 10 unpaired residues represent 10% of the sequence (number of residues at the N- and C-termini not matched/total number of residues in the query sequence) so 10% is subtracted from the percent identity score calculated by the FASTDB program. If the remaining 90 residues were perfectly matched the final percent identity would be 90%. In another example, a 90 residue subject sequence is compared with a 100 residue query sequence. This time the deletions are internal deletions so there are no residues at the N- or C-termini of the subject sequence which are not matched/aligned with the query. In this case the percent identity calculated by FASTDB is not manually corrected. Once again, only residue positions outside the N- and C-terminal ends of the subject sequence, as displayed in the FASTDB alignment, which are not matched/aligned with the query sequence are manually corrected for. No other manual corrections are to made for the purposes of the present invention.

The variant will usually have at least 75% (preferably at least about 80%, 90%, 95% or 99%) sequence identity with a length of normal HA or Therapeutic protein which is the same length as the variant. Homology or identity at the nucleotide or amino acid sequence level is determined by BLAST (Basic Local Alignment Search Tool) analysis using the algorithm employed by the programs blastp, blastn, blastx, tblastn and tblastx (Karlin et al., Proc. Natl. Acad. Sci. USA 87: 2264-2268 (1990) and Altschul, J. Mol. Evol. 36: 290-300 (1993), fully incorporated by reference) which are tailored for sequence similarity searching.

The approach used by the BLAST program is to first consider similar segments between a query sequence and a database sequence, then to evaluate the statistical significance of all matches that are identified and finally to summarize only those matches which satisfy a preselected threshold of significance. For a discussion of basic issues in similarity searching of sequence databases, see Altschul et al., (Nature Genetics 6: 119-129 (1994)) which is fully incorporated by reference. The search parameters for histogram, descriptions, alignments, expect (i.e., the statistical significance threshold for reporting matches against database sequences), cutoff, matrix and filter are at the default settings. The default scoring matrix used by blastp, blastx, tblastn, and tblastx is the BLOSUM62 matrix (Henikoff et al., Proc. Natl. Acad. Sci. USA 89: 10915-10919 (1992), fully incorporated by reference).

For blastn, the scoring matrix is set by the ratios of M (i.e., the reward score for a pair of matching residues) to N (i.e., the penalty score for mismatching residues), wherein the default values for M and N are 5 and −4, respectively. Four blastn parameters may be adjusted as follows: Q=10 (gap creation penalty); R=10 (gap extension penalty); wink=1 (generates word hits at every winkth position along the query); and gapw=16 (sets the window width within which gapped alignments are generated). The equivalent Blastp parameter settings were Q=9; R=2; wink=1; and gapw=32. A Bestfit comparison between sequences, available in the GCG package version 10.0, uses DNA parameters GAP=50 (gap creation penalty) and LEN=3 (gap extension penalty) and the equivalent settings in protein comparisons are GAP=8 and LEN=2.

The polynucleotide variants of the invention may contain alterations in the coding regions, non-coding regions, or both. Especially preferred are polynucleotide variants containing alterations which produce silent substitutions, additions, or deletions, but do not alter the properties or activities of the encoded polypeptide. Nucleotide variants produced by silent substitutions due to the degeneracy of the genetic code are preferred. Moreover, polypeptide variants in which less than 50, less than 40, less than 30, less than 20, less than 10, or 5-50, 5-25, 5-10, 1-5, or 1-2 amino acids are substituted, deleted, or added in any combination are also preferred. Polynucleotide variants can be produced for a variety of reasons, e.g., to optimize codon expression for a particular host (change codons in the human mRNA to those preferred by a bacterial host, such as, yeast or *E. coli*).

In a preferred embodiment, a polynucleotide of the invention which encodes the albumin portion of an albumin fusion protein is optimized for expression in yeast or mammalian cells. In a further preferred embodiment, a polynucleotide of the invention which encodes the Therapeutic protein portion of an albumin fusion protein is optimized for expression in yeast or mammalian cells. In a still further preferred embodiment, a polynucleotide encoding an albumin fusion protein of the invention is optimized for expression in yeast or mammalian cells.

In an alternative embodiment, a codon optimized polynucleotide which encodes a Therapeutic protein portion of an albumin fusion protein does not hybridize to the wild type polynucleotide encoding the Therapeutic protein under stringent hybridization conditions as described herein. In a further embodiment, a codon optimized polynucleotide which encodes an albumin portion of an albumin fusion protein does not hybridize to the wild type polynucleotide encoding the albumin protein under stringent hybridization conditions as described herein. In another embodiment, a codon optimized polynucleotide which encodes an albumin fusion protein does not hybridize to the wild type polynucleotide encoding the Therapeutic protein portion or the albumin protein portion under stringent hybridization conditions as described herein.

In an additional embodiment, a polynucleotide which encodes a Therapeutic protein portion of an albumin fusion protein does not comprise, or alternatively consist of, the naturally occurring sequence of that Therapeutic protein. In a further embodiment, a polynucleotide which encodes an albumin protein portion of an albumin fusion protein does not comprise, or alternatively consist of, the naturally occurring sequence of albumin protein. In an alternative embodiment, a polynucleotide which encodes an albumin fusion protein does not comprise, or alternatively consist of, the naturally occurring sequence of a Therapeutic protein portion or the albumin protein portion.

Naturally occurring variants are called "allelic variants," and refer to one of several alternate forms of a gene occupying a given locus on a chromosome of an organism. (Genes II, Lewin, B., ed., John Wiley & Sons, New York (1985)). These allelic variants can vary at either the polynucleotide and/or polypeptide level and are included in the present invention. Alternatively, non-naturally occurring variants may be produced by mutagenesis techniques or by direct synthesis.

Using known methods of protein engineering and recombinant DNA technology, variants may be generated to improve or alter the characteristics of the polypeptides of the present invention. For instance, one or more amino acids can be deleted from the N-terminus or C-terminus of the polypeptide of the present invention without substantial loss of biological function. As an example, Ron et al. (J. Biol. Chem. 268: 2984-2988 (1993)) reported variant KGF proteins having heparin binding activity even after deleting 3, 8, or 27 amino-terminal amino acid residues. Similarly, Interferon gamma exhibited up to ten times higher activity after deleting 8-10 amino acid residues from the carboxy terminus of this protein. (Dobeli et al., J. Biotechnology 7:199-216 (1988).)

Moreover, ample evidence demonstrates that variants often retain a biological activity similar to that of the naturally occurring protein. For example, Gayle and coworkers (J. Biol. Chem. 268:22105-22111 (1993)) conducted extensive mutational analysis of human cytokine IL-1a. They used random mutagenesis to generate over 3,500 individual IL-1a mutants that averaged 2.5 amino acid changes per variant over the entire length of the molecule. Multiple mutations were examined at every possible amino acid position. The investigators found that "[m]ost of the molecule could be altered with little effect on either [binding or biological activity]." In fact, only 23 unique amino acid sequences, out of more than 3,500 nucleotide sequences examined, produced a protein that significantly differed in activity from wild-type.

Furthermore, even if deleting one or more amino acids from the N-terminus or C-terminus of a polypeptide results in modification or loss of one or more biological functions, other biological activities may still be retained. For example, the ability of a deletion variant to induce and/or to bind antibodies which recognize the secreted form will likely be retained when less than the majority of the residues of the secreted form are removed from the N-terminus or C-terminus. Whether a particular polypeptide lacking N- or C-terminal residues of a protein retains such immunogenic activities can readily be determined by routine methods described herein and otherwise known in the art.

Thus, the invention further includes polypeptide variants which have a functional activity (e.g., biological activity and/or therapeutic activity). In one embodiment, the invention provides variants of albumin fusion proteins that have a functional activity (e.g., biological activity and/or therapeutic activity) that corresponds to one or more biological and/or therapeutic activities of the Therapeutic protein corresponding to the Therapeutic protein portion of the albumin fusion protein. In another embodiment, the invention provides variants of albumin fusion proteins that have a functional activity (e.g., biological activity and/or therapeutic activity) that corresponds to one or more biological and/or therapeutic activities of the Therapeutic protein corresponding to the Therapeutic protein portion of the albumin fusion protein. Such variants include deletions, insertions, inversions, repeats, and substitutions selected according to general rules known in the art so as have little effect on activity. Polynucleotides encoding such variants are also encompassed by the invention.

In preferred embodiments, the variants of the invention have conservative substitutions. By "conservative substitutions" is intended swaps within groups such as replacement of the aliphatic or hydrophobic amino acids Ala, Val, Leu and Ile; replacement of the hydroxyl residues Ser and Thr; replacement of the acidic residues Asp and Glu; replacement of the amide residues Asn and Gln, replacement of the basic residues Lys, Arg, and His; replacement of the aromatic residues Phe, Tyr, and Trp, and replacement of the small-sized amino acids Ala, Ser, Thr, Met, and Gly.

Guidance concerning how to make phenotypically silent amino acid substitutions is provided, for example, in Bowie et al., "Deciphereing the Message in Protein Sequences: Tolerance to Amino Acid Substitutions," Science 247:1306-1310 (1990), wherein the authors indicate that there are two main strategies for studying the tolerance of an amino acid sequence to change.

The first strategy exploits the tolerance of amino acid substitutions by natural selection during the process of evolution. By comparing amino acid sequences in different species, conserved amino acids can be identified. These conserved amino acids are likely important for protein function. In contrast, the amino acid positions where substitutions have been tolerated by natural selection indicates that these positions are not critical for protein function. Thus, positions tolerating amino acid substitution could be modified while still maintaining biological activity of the protein.

The second strategy uses genetic engineering to introduce amino acid changes at specific positions of a cloned gene to identify regions critical for protein function. For example, site directed mutagenesis or alanine-scanning mutagenesis (introduction of single alanine mutations at every residue in the molecule) can be used. See Cunningham and Wells, Science 244:1081-1085 (1989). The resulting mutant molecules can then be tested for biological activity.

As the authors state, these two strategies have revealed that proteins are surprisingly tolerant of amino acid substitutions. The authors further indicate which amino acid changes are likely to be permissive at certain amino acid positions in the protein. For example, most buried (within the tertiary structure of the protein) amino acid residues require nonpolar side chains, whereas few features of surface side chains are generally conserved. Moreover, tolerated conservative amino acid substitutions involve replacement of the aliphatic or hydrophobic amino acids Ala, Val, Leu and Ile; replacement of the hydroxyl residues Ser and Thr; replacement of the acidic residues Asp and Glu; replacement of the amide residues Asn and Gln, replacement of the basic residues Lys, Arg, and His; replacement of the aromatic residues Phe, Tyr, and Trp, and replacement of the small-sized amino acids Ala, Ser, Thr, Met, and Gly. Besides conservative amino acid substitution, variants of the present invention include (i) polypeptides containing substitutions of one or more of the non-conserved amino acid residues, where the substituted amino acid residues may or may not be one encoded by the genetic code, or (ii) polypeptides containing substitutions of one or more of the amino acid residues having a substituent group, or (iii) polypeptides which have been fused with or chemically conjugated to another compound, such as a compound to increase the stability and/or solubility of the polypeptide (for example, polyethylene glycol), (iv) polypeptide containing additional amino acids, such as, for example, an IgG Fc fusion region peptide. Such variant polypeptides are deemed to be within the scope of those skilled in the art from the teachings herein.

For example, polypeptide variants containing amino acid substitutions of charged amino acids with other charged or neutral amino acids may produce proteins with improved characteristics, such as less aggregation. Aggregation of pharmaceutical formulations both reduces activity and increases clearance due to the aggregate's immunogenic activity. See Pinckard et al., Clin. Exp. Immunol. 2:331-340 (1967); Robbins et al., Diabetes 36: 838-845 (1987); Cleland et al., Crit. Rev. Therapeutic Drug Carrier Systems 10:307-377 (1993).

In specific embodiments, the polypeptides of the invention comprise, or alternatively, consist of, fragments or variants of the amino acid sequence of an albumin fusion protein, the amino acid sequence of a Therapeutic protein and/or human serum albumin, wherein the fragments or variants have 1-5, 5-10, 5-25, 5-50, 10-50 or 50-150, amino acid residue additions, substitutions, and/or deletions when compared to the reference amino acid sequence. In preferred embodiments, the amino acid substitutions are conservative. Nucleic acids encoding these polypeptides are also encompassed by the invention.

The polypeptide of the present invention can be composed of amino acids joined to each other by peptide bonds or modified peptide bonds, i.e., peptide isosteres, and may contain amino acids other than the 20 gene-encoded amino acids. The polypeptides may be modified by either natural processes, such as post-translational processing, or by chemical modification techniques which are well known in the art. Such modifications are well described in basic texts and in more detailed monographs, as well as in a voluminous research literature. Modifications can occur anywhere in a polypeptide, including the peptide backbone, the amino acid side-chains and the amino or carboxyl termini. It will be appreciated that the same type of modification may be present in the same or varying degrees at several sites in a given polypeptide. Also, a given polypeptide may contain many types of modifications. Polypeptides may be branched, for example, as a result of ubiquitination, and they may be cyclic, with or without branching. Cyclic, branched, and branched cyclic polypeptides may result from posttranslation natural processes or may be made by synthetic methods. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent cross-links, formation of cysteine, formation of pyroglutamate, formylation, gamma-carboxylation, glycosylation, GPI anchor formation, hydroxylation, iodination, methylation, myristylation, oxidation, pegylation, proteolytic processing, phosphorylation, prenylation, racemization, selenoylation, sulfation, transfer-RNA mediated addition of amino acids to proteins such as arginylation, and ubiquitination. (See, for instance, PROTEINS—STRUCTURE AND MOLECULAR PROPERTIES, 2nd Ed., T. E. Creighton, W. H. Freeman and Company, New York (1993); POST-TRANSLATIONAL COVALENT MODIFICATION OF PROTEINS, B. C. Johnson, Ed., Academic Press, New York, pgs. 1-12 (1983); Seifter et al., Meth. Enzymol. 182: 626-646 (1990); Rattan et al., Ann. N.Y. Acad. Sci. 663:48-62 (1992)).

Functional Activity

"A polypeptide having functional activity" refers to a polypeptide capable of displaying one or more known functional activities associated with the full-length, pro-protein, and/or mature form of a Therapeutic protein. Such functional activities include, but are not limited to, biological activity, antigenicity [ability to bind (or compete with a polypeptide for binding) to an anti-polypeptide antibody], immunogenicity (ability to generate antibody which binds to a specific polypeptide of the invention), ability to form multimers with polypeptides of the invention, and ability to bind to a receptor or ligand for a polypeptide.

"A polypeptide having biological activity" refers to a polypeptide exhibiting activity similar to, but not necessarily identical to, an activity of a Therapeutic protein of the present invention, including mature forms, as measured in a particular biological assay, with or without dose dependency. In the case where dose dependency does exist, it need not be identical to that of the polypeptide, but rather substantially similar to the dose-dependence in a given activity as compared to the polypeptide of the present invention (i.e., the candidate polypeptide will exhibit greater activity or not more than about 25-fold less and, preferably, not more than about tenfold less activity, and most preferably, not more than about three-fold less activity relative to the polypeptide of the present invention).

In preferred embodiments, an albumin fusion protein of the invention has at least one biological and/or therapeutic activity associated with the Therapeutic protein portion (or fragment or variant thereof) when it is not fused to albumin.

In additional preferred embodiments, the albumin fusion protein of the invention has an increased plasma stability compared to the Therapeutic protein portion (or fragment or variant thereof) in an unfused state. Plasma stability of the albumin fusion protein of the invention or of the unfused Therapeutic protein portion (or fragment or variant thereof) can be assayed using or routinely modifying assays known in the art.

The albumin fusion proteins of the invention can be assayed for functional activity (e.g., biological activity) using or routinely modifying assays known in the art, as well as assays described herein. Additionally, one of skill in the art may routinely assay fragments of a Therapeutic protein corresponding to a Therapeutic protein portion of an albumin fusion protein, for activity using assays referenced in its corresponding row of Table 1 (e.g., in column 3 of Table 1). Further, one of skill in the art may routinely assay fragments of an albumin protein corresponding to an albumin protein portion of an albumin fusion protein, for activity using assays known in the art and/or as described in the Examples section below.

For example, in one embodiment where one is assaying for the ability of an albumin fusion protein to bind or compete with a Therapeutic protein for binding to an anti-Therapeutic polypeptide antibody and/or anti-albumin antibody, various immunoassays known in the art can be used, including but not limited to, competitive and non-competitive assay systems using techniques such as radioimmunoassays, ELISA (enzyme linked immunosorbent assay), "sandwich" immunoassays, immunoradiometric assays, gel diffusion precipitation reactions, immunodiffusion assays, in situ immunoassays (using colloidal gold, enzyme or radioisotope labels, for example), western blots, precipitation reactions, agglutination assays (e.g., gel agglutination assays, hemagglutination assays), complement fixation assays, immunofluorescence assays, protein A assays, and immunoelectrophoresis assays, etc. In one embodiment, antibody binding is detected by detecting a label on the primary antibody. In another embodiment, the primary antibody is detected by detecting binding of a secondary antibody or reagent to the primary antibody. In a further embodiment, the secondary antibody is labeled. Many means are known in the art for detecting binding in an immunoassay and are within the scope of the present invention.

In a preferred embodiment, where a binding partner (e.g., a receptor or a ligand) of a Therapeutic protein is identified, binding to that binding partner by an albumin fusion protein which comprises that Therapeutic protein as the Therapeutic protein portion of the fusion can be assayed, e.g., by means well-known in the art, such as, for example, reducing and non-reducing gel chromatography, protein affinity chromatography, and affinity blotting. See generally, Phizicky et al., Microbiol. Rev. 59:94-123 (1995). In another embodiment, the ability of physiological correlates of an albumin fusion protein to bind to a substrate(s) of the Therapeutic polypeptide corresponding to the Therapeutic protein portion of the fusion can be routinely assayed using techniques known in the art.

In an alternative embodiment, where the ability of an albumin fusion protein to multimerize is being evaluated, association with other components of the multimer can be assayed, e.g., by means well-known in the art, such as, for example, reducing and non-reducing gel chromatography, protein affinity chromatography, and affinity blotting. See generally, Phizicky et al., supra.

In preferred embodiments, an albumin fusion protein comprising all or a portion of an antibody that binds a Therapeutic protein, has at least one biological and/or therapeutic activity (e.g., to specifically bind a polypeptide or epitope) associated with the antibody that binds a Therapeutic protein (or fragment or variant thereof) when it is not fused to albumin. In other preferred embodiments, the biological activity and/or therapeutic activity of an albumin fusion protein comprising all or a portion of an antibody that binds a Therapeutic protein is the inhibition (i.e., antagonism) or activation (i.e., agonism) of one or more of the biological activities and/or therapeutic activities associated with the polypeptide that is specifically bound by antibody that binds a Therapeutic protein.

Albumin fusion proteins comprising at least a fragment or variant of an antibody that binds a Therapeutic protein may be characterized in a variety of ways. In particular, albumin fusion proteins comprising at least a fragment or variant of an antibody that binds a Therapeutic protein may be assayed for the ability to specifically bind to the same antigens specifically bound by the antibody that binds a Therapeutic protein corresponding to the Therapeutic protein portion of the albumin fusion protein using techniques described herein or routinely modifying techniques known in the art.

Assays for the ability of the albumin fusion proteins (e.g., comprising at least a fragment or variant of an antibody that binds a Therapeutic protein) to (specifically) bind a specific protein or epitope may be performed in solution (e.g., Houghten, Bio/Techniques 13:412-421 (1992)), on beads (e.g., Lam, Nature 354:82-84 (1991)), on chips (e.g., Fodor, Nature 364:555-556 (1993)), on bacteria (e.g., U.S. Pat. No. 5,223,409), on spores (e.g., U.S. Pat. Nos. 5,571,698; 5,403,484; and 5,223,409), on plasmids (e.g., Cull et al., Proc. Natl. Acad. Sci. USA 89:1865-1869 (1992)) or on phage (e.g., Scott and Smith, Science 249:386-390 (1990); Devlin, Science 249:404-406 (1990); Cwirla et al., Proc. Natl. Acad. Sci. USA 87:6378-6382 (1990); and Felici, J. Mol. Biol. 222:301-310 (1991)) (each of these references is incorporated herein in its entirety by reference). Albumin fusion proteins comprising at least a fragment or variant of a Therapeutic antibody may also be assayed for their specificity and affinity for a specific protein or epitope using or routinely modifying techniques described herein or otherwise known in the art.

The albumin fusion proteins comprising at least a fragment or variant of an antibody that binds a Therapeutic protein may be assayed for cross-reactivity with other antigens (e.g., molecules that have sequence/structure conservation with the molecule(s) specifically bound by the antibody that binds a Therapeutic protein (or fragment or variant thereof) corresponding to the Therapeutic protein portion of the albumin fusion protein of the invention) by any method known in the art.

Immunoassays which can be used to analyze (immunospecific) binding and cross-reactivity include, but are not limited to, competitive and non-competitive assay systems using techniques such as western blots, radioimmunoassays, ELISA (enzyme linked immunosorbent assay), "sandwich" immunoassays, immunoprecipitation assays, precipitin reactions, gel diffusion precipitin reactions, immunodiffusion assays, agglutination assays, complement-fixation assays, immunoradiometric assays, fluorescent immunoassays, and protein A immunoassays, to name but a few. Such assays are routine and well known in the art (see, e.g., Ausubel et al, eds, 1994, Current Protocols in Molecular Biology, Vol. 1, John Wiley & Sons, Inc., New York, which is incorporated by reference herein in its entirety). Exemplary immunoassays are described briefly below (but are not intended by way of limitation).

Immunoprecipitation protocols generally comprise lysing a population of cells in a lysis buffer such as RIPA buffer (1% NP-40 or Triton X-100, 1% sodium deoxycholate, 0.1% SDS, 0.15 M NaCl, 0.01 M sodium phosphate at pH 7.2, 1% Trasylol) supplemented with protein phosphatase and/or protease inhibitors (e.g., EDTA, PMSF, aprotinin, sodium vanadate), adding the albumin fusion protein of the invention (e.g., comprising at least a fragment or variant of an antibody that binds a Therapeutic protein) to the cell lysate, incubating for a period of time (e.g., 1 to 4 hours) at 40 degrees C., adding sepharose beads coupled to an anti-albumin antibody, for example, to the cell lysate, incubating for about an hour or more at 40 degrees C., washing the beads in lysis buffer and resuspending the beads in SDS/sample buffer. The ability of the albumin fusion protein to immunoprecipitate a particular antigen can be assessed by, e.g., western blot analysis. One of skill in the art would be knowledgeable as to the parameters that can be modified to increase the binding of the albumin fusion protein to an antigen and decrease the background (e.g., pre-clearing the cell lysate with sepharose beads). For further discussion regarding immunoprecipitation protocols see, e.g., Ausubel et al, eds, 1994, Current Protocols in Molecular Biology, Vol. 1, John Wiley & Sons, Inc., New York at 10.16.1.

Western blot analysis generally comprises preparing protein samples, electrophoresis of the protein samples in a polyacrylamide gel (e.g., 8%-20% SDS-PAGE depending on the molecular weight of the antigen), transferring the protein sample from the polyacrylamide gel to a membrane such as nitrocellulose, PVDF or nylon, blocking the membrane in blocking solution (e.g., PBS with 3% BSA or non-fat milk), washing the membrane in washing buffer (e.g., PBS-Tween 20), applying the albumin fusion protein of the invention (diluted in blocking buffer) to the membrane, washing the membrane in washing buffer, applying a secondary antibody (which recognizes the albumin fusion protein, e.g., an anti-human serum albumin antibody) conjugated to an enzymatic substrate (e.g., horseradish peroxidase or alkaline phosphatase) or radioactive molecule (e.g., $^{32}$P or $^{125}$I) diluted in blocking buffer, washing the membrane in wash buffer, and detecting the presence of the antigen. One of skill in the art would be knowledgeable as to the parameters that can be modified to increase the signal detected and to reduce the background noise. For further discussion regarding western blot protocols see, e.g., Ausubel et al, eds, 1994, Current Protocols in Molecular Biology, Vol. 1, John Wiley & Sons, Inc., New York at 10.8.1.

ELISAs comprise preparing antigen, coating the well of a 96-well microtiter plate with the antigen, washing away antigen that did not bind the wells, adding the albumin fusion protein (e.g., comprising at least a fragment or variant of an antibody that binds a Therapeutic protein) of the invention conjugated to a detectable compound such as an enzymatic substrate (e.g., horseradish peroxidase or alkaline phosphatase) to the wells and incubating for a period of time, washing away unbound or non-specifically bound albumin fusion proteins, and detecting the presence of the albumin fusion proteins specifically bound to the antigen coating the well. In ELISAs the albumin fusion protein does not have to be conjugated to a detectable compound; instead, a second antibody (which recognizes albumin fusion protein) conjugated to a detectable compound may be added to the well. Further, instead of coating the well with the antigen, the albumin fusion protein may be coated to the well. In this case, the detectable molecule could be the antigen conjugated to a detectable compound such as an enzymatic substrate (e.g., horseradish peroxidase or alkaline phosphatase). One of skill in the art would be knowledgeable as to the parameters that can be modified to increase the signal detected as well as other variations of ELISAs known in the art. For further discussion regarding ELISAs see, e.g., Ausubel et al, eds, 1994, Current Protocols in Molecular Biology, Vol. 1, John Wiley & Sons, Inc., New York at 11.2.1.

The binding affinity of an albumin fusion protein to a protein, antigen, or epitope and the off-rate of an albumin fusion protein-protein/antigen/epitope interaction can be determined by competitive binding assays. One example of a competitive binding assay is a radioimmunoassay comprising the incubation of labeled antigen (e.g., $^{3}$H or $^{125}$I) with the albumin fusion protein of the invention in the presence of increasing amounts of unlabeled antigen, and the detection of the antibody bound to the labeled antigen. The affinity of the albumin fusion protein for a specific protein, antigen, or epitope and the binding off-rates can be determined from the data by Scatchard plot analysis. Competition with a second protein that binds the same protein, antigen or epitope as the albumin fusion protein, can also be determined using radioimmunoassays. In this case, the protein, antigen or epitope is incubated with an albumin fusion protein conjugated to a labeled compound (e.g., $^{3}$H or $^{125}$I) in the presence of increasing amounts of an unlabeled second protein that binds the same protein, antigen, or epitope as the albumin fusion protein of the invention.

In a preferred embodiment, BIAcore kinetic analysis is used to determine the binding on and off rates of albumin fusion proteins of the invention to a protein, antigen or epitope. BIAcore kinetic analysis comprises analyzing the binding and dissociation of albumin fusion proteins, or specific polypeptides, antigens or epitopes from chips with immobilized specific polypeptides, antigens or epitopes or albumin fusion proteins, respectively, on their surface.

Antibodies that bind a Therapeutic protein corresponding to the Therapeutic protein portion of an albumin fusion protein may also be described or specified in terms of their binding affinity for a given protein or antigen, preferably the antigen which they specifically bind. Preferred binding affinities include those with a dissociation constant or Kd less than $5\times10^{-2}$ M, $10^{-2}$ M, $5\times10^{-3}$ M, $10^{-3}$ M, $5\times10^{-4}$ M, $10^{-4}$ M. More preferred binding affinities include those with a dissociation constant or Kd less than $5\times10^{-5}$ M, $10^{-5}$ M, $5\times10^{-6}$ M, $10^{-6}$M, $5\times10^{-7}$ M, $10^{7}$ M, $5\times10^{-8}$ M or $10^{-8}$ M. Even more preferred binding affinities include those with a dissociation constant or Kd less than $5\times10^{-9}$ M, $10^{-9}$ M, $5\times10^{-10}$ M, $10^{-10}$ M, $5\times10^{-11}$ M, $10^{-11}$ M, $5\times10^{-12}$ M, $10^{-12}$ M, $5\times10^{13}$ M, $10^{13}$ M, $5\times10^{-14}$ M, $10^{-14}$ M, $5\times10^{15}$ M, or $10^{-15}$ M. In preferred embodiments, albumin fusion proteins comprising at least a fragment or variant of an antibody that binds a Therapeutic protein, has an affinity for a given protein or epitope similar to that of the corresponding antibody (not fused to albumin) that binds a Therapeutic protein, taking into account the valency of the albumin fusion protein (comprising at least a fragment or variant of an antibody that binds a Therapeutic protein) and the valency of the corresponding antibody. In addition, assays described herein (see Examples and Table 1) and otherwise known in the art may routinely be applied to measure the ability of albumin fusion proteins and fragments, variants and derivatives thereof to elicit biological activity and/or Therapeutic activity (either in vitro or in vivo) related to either the Therapeutic protein portion and/or albumin portion of the albumin fusion protein. Other methods will be known to the skilled artisan and are within the scope of the invention.

Albumin

As described above, an albumin fusion protein of the invention comprises at least a fragment or variant of a Therapeutic protein and at least a fragment or variant of human serum albumin, which are associated with one another, preferably by genetic fusion.

An additional embodiment comprises at least a fragment or variant of a Therapeutic protein and at least a fragment or variant of human serum albumin, which are linked to one another by chemical conjugation.

The terms, human serum albumin (HSA) and human albumin (HA) are used interchangeably herein. The terms, "albumin and "serum albumin" are broader, and encompass human serum albumin (and fragments and variants thereof) as well as albumin from other species (and fragments and variants thereof).

As used herein, "albumin" refers collectively to albumin protein or amino acid sequence, or an albumin fragment or variant, having one or more functional activities (e.g., biological activities) of albumin. In particular, "albumin" refers to human albumin or fragments thereof (see for example, EP 201 239, EP 322 094 WO 97/24445, WO95/23857) especially the mature form of human albumin as shown in FIG. 1 and SEQ ID NO:1, or albumin from other vertebrates or fragments thereof, or analogs or variants of these molecules or fragments thereof.

In preferred embodiments, the human serum albumin protein used in the albumin fusion proteins of the invention contains one or both of the following sets of point mutations with reference to SEQ ID NO:1: Leu-407 to Ala, Leu-408 to Val, Val-409 to Ala, and Arg-410 to Ala; or Arg-410 to A, Lys-413 to Gln, and Lys-414 to Gln (see, e.g., International Publication No. WO95/23857, hereby incorporated in its entirety by reference herein). In even more preferred embodiments, albumin fusion proteins of the invention that contain one or both of above-described sets of point mutations have improved stability/resistance to yeast Yap3p proteolytic cleavage, allowing increased production of recombinant albumin fusion proteins expressed in yeast host cells.

As used herein, a portion of albumin sufficient to prolong the therapeutic activity or plasma stability or shelf-life of the Therapeutic protein refers to a portion of albumin sufficient in length or structure to stabilize or prolong the therapeutic activity or plasma stability of the protein so that the shelf life or plasma stability of the Therapeutic protein portion of the albumin fusion protein is prolonged or extended compared to the shelf-life or plasma stability in the non-fusion state. The albumin portion of the albumin fusion proteins may comprise the full length of the HA sequence as described above, or may include one or more fragments thereof that are capable of stabilizing or prolonging the therapeutic activity. Such fragments may be of 10 or more amino acids in length or may include about 15, 20, 25, 30, 50, or more contiguous amino acids from the HA sequence or may include part or all of specific domains of HA. For instance, one or more fragments of HA spanning the first two immunoglobulin-like domains may be used. In a preferred embodiment, the HA fragment is the mature form of HA.

The albumin portion of the albumin fusion proteins of the invention may be a variant of normal HA. The Therapeutic protein portion of the albumin fusion proteins of the invention may also be variants of the Therapeutic proteins as described herein. The term "variants" includes insertions, deletions and substitutions, either conservative or non conservative, where such changes do not substantially alter one or more of the oncotic, useful ligand-binding and non-immunogenic properties of albumin, or the active site, or active domain which confers the therapeutic activities of the Therapeutic proteins.

In particular, the albumin fusion proteins of the invention may include naturally occurring polymorphic variants of human albumin and fragments of human albumin, for example those fragments disclosed in EP 322 094 (namely HA (Pn), where n is 369 to 419). The albumin may be derived from any vertebrate, especially any mammal, for example human, cow, sheep, or pig. Non-mammalian albumins include, but are not limited to, hen and salmon. The albumin portion of the albumin fusion protein may be from a different animal than the Therapeutic protein portion.

Generally speaking, an HA fragment or variant will be at least 100 amino acids long, preferably at least 150 amino acids long. The HA variant may consist of or alternatively comprise at least one whole domain of HA, for example domains 1 (amino acids 1-194 of SEQ ID NO:1), domain 2 (amino acids 195-387 of SEQ ID NO:1), domain 3 (amino acids 388-585 of SEQ ID NO:1), domains 1 and 2 (1-387 of SEQ ID NO:1), domains 2 and 3 (195-585 of SEQ ID NO:1) or domains 1 and 3 (amino acids 1-194 of SEQ ID NO:1 and amino acids 388-585 of SEQ ID NO:1). Each domain is itself made up of two homologous subdomains namely 1-105, 120-194, 195-291, 316-387, 388-491 and 512-585, with flexible inter-subdomain linker regions comprising residues Lys106 to Glu119, Glu292 to Val 315 and Glu492 to Ala511.

Preferably, the albumin portion of an albumin fusion protein of the invention comprises at least one subdomain or domain of HA or conservative modifications thereof. If the fusion is based on subdomains, some or all of the adjacent linker is preferably used to link to the Therapeutic protein moiety.

Antibodies that Specifically Bind Therapeutic Proteins are Also Therapeutic Proteins The present invention also encompasses albumin fusion proteins that comprise at least a fragment or variant of an antibody that specifically binds a Therapeutic protein disclosed in Table 1. It is specifically contemplated that the term "Therapeutic protein" encompasses antibodies that bind a Therapeutic protein (e.g., as Described in column I of Table 1) and fragments and variants thereof. Thus an albumin fusion protein of the invention may contain at least a fragment or variant of a Therapeutic protein, and/or at least a fragment or variant of an antibody that binds a Therapeutic protein.

Antibody Structure and Background

The basic antibody structural unit is known to comprise a tetramer. Each tetramer is composed of two identical pairs of polypeptide chains, each pair having one "light" (about 25 kDa) and one "heavy" chain (about 50-70 kDa). The amino-terminal portion of each chain includes a variable region of about 100 to 110 or more amino acids primarily responsible for antigen recognition. The carboxy-terminal portion of each chain defines a constant region primarily responsible for effector function. Human light chains are classified as kappa and lambda light chains. Heavy chains are classified as mu, delta, gamma, alpha, or epsilon, and define the antibody's isotype as IgM, IgD, IgG, IgA, and IgE, respectively. See generally, *Fundamental Immunology* Chapters 3-5 (Paul, W., ed., 4th ed. Raven Press, N.Y. (1998)) (incorporated by reference in its entirety for all purposes). The variable regions of each light/heavy chain pair form the antibody binding site.

Thus, an intact IgG antibody has two binding sites. Except in bifunctional or bispecific antibodies, the two binding sites are the same.

The chains all exhibit the same general structure of relatively conserved framework regions (FR) joined by three hypervariable regions, also called complementarity determining regions or CDRs. The CDR regions, in general, are the portions of the antibody which make contact with the antigen and determine its specificity. The CDRs from the heavy and the light chains of each pair are aligned by the framework regions, enabling binding to a specific epitope. From N-terminal to C-terminal, both light and heavy chains variable regions comprise the domains FR1, CDR1, FR2, CDR2, FR3, CDR3 and FR4. The variable regions are connected to the heavy or light chain constant region. The assignment of amino acids to each domain is in accordance with the definitions of Kabat *Sequences of Proteins of Immunological Interest* (National Institutes of Health, Bethesda, Md. (1987 and 1991)), or Chothia & Lesk J *Mol. Biol.* 196:901-917 (1987); Chothia et al. Nature 342:878-883 (1989).

As used herein, "antibody" refers to immunoglobulin molecules and immunologically active portions of immunoglobulin molecules, i.e., molecules that contain an antigen binding site that specifically binds an antigen (e.g., a molecule containing one or more CDR regions of an antibody). Antibodies that may correspond to a Therapeutic protein portion of an albumin fusion protein include, but are not limited to, monoclonal, multispecific, human, humanized or chimeric antibodies, single chain antibodies (e.g., single chain Fvs), Fab fragments, F(ab') fragments, fragments produced by a Fab expression library, anti-idiotypic (anti-Id) antibodies (including, e.g., anti-Id antibodies specific to antibodies of the invention), and epitope-binding fragments of any of the above (e.g., VH domains, VL domains, or one or more CDR regions).

Antibodies that Bind Therapeutic Proteins

The present invention encompasses albumin fusion proteins that comprise at least a fragment or variant of an antibody that binds a Therapeutic Protein (e.g., as disclosed in Table 1) or fragment or variant thereof.

Antibodies that bind a Therapeutic protein (or fragment or variant thereof) may be from any animal origin, including birds and mammals. Preferably, the antibodies are human, murine (e.g., mouse and rat), donkey, sheep, rabbit, goat, guinea pig, camel, horse, or chicken antibodies. Most preferably, the antibodies are human antibodies. As used herein, "human" antibodies include antibodies having the amino acid sequence of a human immunoglobulin and include antibodies isolated from human immunoglobulin libraries and xenomice or other organisms that have been genetically engineered to produce human antibodies.

The antibody molecules that bind to a Therapeutic protein and that may correspond to a Therapeutic protein portion of an albumin fusion protein of the invention can be of any type (e.g., IgG, IgE, IgM, IgD, IgA and IgY), class (e.g., IgG1, IgG2, IgG3, IgG4, IgA1 and IgA2) or subclass of immunoglobulin molecule. In preferred embodiments, the antibody molecules that bind to a Therapeutic protein and that may correspond to a Therapeutic protein portion of an albumin fusion protein are IgG1. In other preferred embodiments, the immunoglobulin molecules that bind to a Therapeutic protein and that may correspond to a Therapeutic protein portion of an albumin fusion protein are IgG2. In other preferred embodiments, the immunoglobulin molecules that bind to a Therapeutic protein and that may correspond to a Therapeutic protein portion of an albumin fusion protein are IgG4.

Most preferably the antibodies that bind to a Therapeutic protein and that may correspond to a Therapeutic protein portion of an albumin fusion protein are human antigen-binding antibody fragments of the present invention and include, but are not limited to, Fab, Fab' and F(ab')2, Fd, single-chain Fvs (scFv), single-chain antibodies, disulfide-linked Fvs (sdFv) and fragments comprising either a VL or VH domain. Antigen-binding antibody fragments, including single-chain antibodies, may comprise the variable region(s) alone or in combination with the entirety or a portion of the following: hinge region, CH1, CH2, and CH3 domains.

The antibodies that bind to a Therapeutic protein and that may correspond to a Therapeutic protein portion of an albumin fusion protein may be monospecific, bispecific, trispecific or of greater multispecificity. Multispecific antibodies may be specific for different epitopes of a Therapeutic protein or may be specific for both a Therapeutic protein as well as for a heterologous epitope, such as a heterologous polypeptide or solid support material. See, e.g., PCT publications WO 93/17715; WO 92/08802; WO 91/00360; WO 92/05793; Tutt, et al., J. Immunol. 147:60-69 (1991); U.S. Pat. Nos. 4,474,893; 4,714,681; 4,925,648; 5,573,920; 5,601,819; Kostelny et al., J. Immunol. 148:1547-1553 (1992).

Antibodies that bind a Therapeutic protein (or fragment or variant thereof) may be bispecific or bifunctional which means that the antibody is an artificial hybrid antibody having two different heavy/light chain pairs and two different binding sites. Bispecific antibodies can be produced by a variety of methods including fusion of hybridomas or linking of Fab' fragments. See, e.g., Songsivilai & Lachmann *Clin. Exp. Immunol.* 79: 315-321 (1990), Kostelny et al. J *Immunol.* 148:1547 1553 (1992). In addition, bispecific antibodies may be formed as "diabodies" (Holliger et al. "'Diabodies': small bivalent and bispecific antibody fragments" PNAS USA 90:6444-6448 (1993)) or "Janusins" (Traunecker et al. "Bispecific single chain molecules (Janusins) target cytotoxic lymphocytes on HIV infected cells" *EMBO J* 10:3655-3659 (1991) and Traunecker et al. "Janusin: new molecular design for bispecific reagents" *Int J Cancer Suppl* 7:51-52 (1992)).

The present invention also provides albumin fusion proteins that comprise, fragments or variants (including derivatives) of an antibody described herein or known elsewhere in the art. Standard techniques known to those of skill in the art can be used to introduce mutations in the nucleotide sequence encoding a molecule of the invention, including, for example, site-directed mutagenesis and PCR-mediated mutagenesis which result in amino acid substitutions. Preferably, the variants (including derivatives) encode less than 50 amino acid substitutions, less than 40 amino acid substitutions, less than 30 amino acid substitutions, less than 25 amino acid substitutions, less than 20 amino acid substitutions, less than 15 amino acid substitutions, less than 10 amino acid substitutions, less than 5 amino acid substitutions, less than 4 amino acid substitutions, less than 3 amino acid substitutions, or less than 2 amino acid substitutions relative to the reference VH domain, VHCDR1, VHCDR2, VHCDR3, VL domain, VLCDR1, VLCDR2, or VLCDR3. In specific embodiments, the variants encode substitutions of VHCDR3. In a preferred embodiment, the variants have conservative amino acid substitutions at one or more predicted non-essential amino acid residues.

Antibodies that bind to a Therapeutic protein and that may correspond to a Therapeutic protein portion of an albumin fusion protein may be described or specified in terms of the epitope(s) or portion(s) of a Therapeutic protein which they recognize or specifically bind. Antibodies which specifically bind a Therapeutic protein or a specific epitope of a Therapeutic protein may also be excluded. Therefore, the present invention encompasses antibodies that specifically bind Therapeutic proteins, and allows for the exclusion of the same. In preferred embodiments, albumin fusion proteins comprising at least a fragment or variant of an antibody that binds a Therapeutic protein, binds the same epitopes as the unfused fragment or variant of that antibody itself.

Antibodies that bind to a Therapeutic protein and that may correspond to a Therapeutic protein portion of an albumin fusion protein may also be described or specified in terms of their cross-reactivity. Antibodies that do not bind any other analog, ortholog, or homolog of a Therapeutic protein are included. Antibodies that bind polypeptides with at least 95%, at least 90%, at least 85%, at least 80%, at least 75%, at least 70%, at least 65%, at least 60%, at least 55%, and at least 50% sequence identity (as calculated using methods known in the art and described herein) to a Therapeutic protein are also included in the present invention. In specific embodiments, antibodies that bind to a Therapeutic protein and that may correspond to a Therapeutic protein portion of an albumin fusion protein cross-react with murine, rat and/or rabbit homologs of human proteins and the corresponding epitopes thereof. Antibodies that do not bind polypeptides with less than 95%, less than 90%, less than 85%, less than 80%, less than 75%, less than 70%, less than 65%, less than 60%, less than 55%, and less than 50% sequence identity (as calculated using methods known in the art and described herein) to a Therapeutic protein are also included in the present invention. In a specific embodiment, the above-described cross-reactivity is with respect to any single specific antigenic or immunogenic polypeptide, or combination(s) of 2, 3, 4, 5, or more of the specific antigenic and/or immunogenic polypeptides disclosed herein. In preferred embodiments, albumin fusion proteins comprising at least a fragment or variant of an antibody that binds a Therapeutic protein, has similar or substantially identical cross reactivity characteristics compared to the fragment or variant of that particular antibody itself.

Further included in the present invention are antibodies which bind polypeptides encoded by polynucleotides which hybridize to a polynucleotide encoding a Therapeutic protein under stringent hybridization conditions (as described herein). Antibodies that bind to a Therapeutic protein and that may correspond to a Therapeutic protein portion of an albumin fusion protein of the invention may also be described or specified in terms of their binding affinity to a polypeptide of the invention. Preferred binding affinities include those with a dissociation constant or Kd less than $5\times10^{-2}$ M, $10^{-2}$ M, $5\times10^{-3}$ M, $10^{-3}$ M, $5\times10^{-4}$ M, $10^{-4}$ M. More preferred binding affinities include those with a dissociation constant or Kd less than $5\times10^{-5}$ M, $10^{-5}$ M, $5\times10^{-6}$ M, $10^{-6}$M, $5\times10^{-7}$ M, $10^{7}$ M, $5\times10^{-8}$ M or $10^{-8}$ M. Even more preferred binding affinities include those with a dissociation constant or Kd less than $5\times10^{-9}$ M, $10^{-9}$ M, $5\times10^{-10}$ M, $10^{-10}$ M, $5\times10^{-11}$ M, $10^{-11}$ M, $5\times10^{-12}$ M, $^{10-12}$ M, $5\times10^{-13}$ M, $10^{-13}$ M, $5\times10^{-14}$ M, $10^{-14}$ M, $5\times10^{-15}$ M, or $10^{-15}$ M. In preferred embodiments, albumin fusion proteins comprising at least a fragment or variant of an antibody that binds a Therapeutic protein, has an affinity for a given protein or epitope similar to that of the corresponding antibody (not fused to albumin) that binds a Therapeutic protein, taking into account the valency of the albumin fusion protein (comprising at least a fragment or variant of an antibody that binds a Therapeutic protein) and the valency of the corresponding antibody.

The invention also provides antibodies that competitively inhibit binding of an antibody to an epitope of a Therapeutic protein as determined by any method known in the art for determining competitive binding, for example, the immunoassays described herein. In preferred embodiments, the antibody competitively inhibits binding to the epitope by at least 95%, at least 90%, at least 85%, at least 80%, at least 75%, at least 70%, at least 60%, or at least 50%. In preferred embodiments, albumin fusion proteins comprising at least a fragment or variant of an antibody that binds a Therapeutic protein, competitively inhibits binding of a second antibody to an epitope of a Therapeutic protein. In other preferred embodiments, albumin fusion proteins comprising at least a fragment or variant of an antibody that binds a Therapeutic protein, competitively inhibits binding of a second antibody to an epitope of a Therapeutic protein by at least 95%, at least 90%, at least 85%, at least 80%, at least 75%, at least 70%, at least 60%, or at least 50%.

Antibodies that bind to a Therapeutic protein and that may correspond to a Therapeutic protein portion of an albumin fusion protein of the invention may act as agonists or antagonists of the Therapeutic protein. For example, the present invention includes antibodies which disrupt the receptor/ligand interactions with the polypeptides of the invention either partially or fully. The invention features both receptor-specific antibodies and ligand-specific antibodies. The invention also features receptor-specific antibodies which do not prevent ligand binding but prevent receptor activation. Receptor activation (i.e., signaling) may be determined by techniques described herein or otherwise known in the art. For example, receptor activation can be determined by detecting the phosphorylation (e.g., tyrosine or serine/threonine) of the receptor or its substrate by immunoprecipitation followed by western blot analysis (for example, as described supra). In specific embodiments, antibodies are provided that inhibit ligand activity or receptor activity by at least 95%, at least 90%, at least 85%, at least 80%, at least 75%, at least 70%, at least 60%, or at least 50% of the activity in absence of the antibody. In preferred embodiments, albumin fusion proteins comprising at least a fragment or variant of an antibody that binds a Therapeutic protein, has similar or substantially similar characteristics with regard to preventing ligand binding and/or preventing receptor activation compared to an unfused fragment or variant of the antibody that binds the Therapeutic protein.

The invention also features receptor-specific antibodies which both prevent ligand binding and receptor activation as well as antibodies that recognize the receptor-ligand complex, and, preferably, do not specifically recognize the unbound receptor or the unbound ligand. Likewise, included in the invention are neutralizing antibodies which bind the ligand and prevent binding of the ligand to the receptor, as well as antibodies which bind the ligand, thereby preventing receptor activation, but do not prevent the ligand from binding the receptor. Further included in the invention are antibodies which activate the receptor. These antibodies may act as receptor agonists, i.e., potentiate or activate either all or a subset of the biological activities of the ligand-mediated receptor activation, for example, by inducing dimerization of the receptor. The antibodies may be specified as agonists, antagonists or inverse agonists for biological activities comprising the specific biological activities of the Therapeutic proteins (e.g. as disclosed in Table 1). The above antibody agonists can be made using methods known in the art. See, e.g., PCT publication WO 96/40281; U.S. Pat. No. 5,811,097;

Deng et al., Blood 92(6):1981-1988 (1998); Chen et al., Cancer Res. 58(16):3668-3678 (1998); Harrop et al., J. Immunol. 161(4):1786-1794 (1998); Zhu et al., Cancer Res. 58(15): 3209-3214 (1998); Yoon et al., J. Immunol. 160(7):3170-3179 (1998); Prat et al., J. Cell. Sci. 111(Pt2):237-247 (1998); Pitard et al., J. Immunol. Methods 205(2):177-190 (1997); Liautard et al., Cytokine 9(4):233-241 (1997); Carlson et al., J. Biol. Chem. 272(17):11295-11301 (1997); Taryman et al., Neuron 14(4):755-762 (1995); Muller et al., Structure 6(9): 1153-1167 (1998); Bartunek et al., Cytokine 8(1):14-20 (1996) (which are all incorporated by reference herein in their entireties). In preferred embodiments, albumin fusion proteins comprising at least a fragment or variant of an antibody that binds a Therapeutic protein, have similar or substantially identical agonist or antagonist properties as an un-fused fragment or variant of the antibody that binds the Therapeutic protein.

Antibodies that bind to a Therapeutic protein and that may correspond to a Therapeutic protein portion of an albumin fusion protein of the invention may be used, for example, to purify, detect, and target Therapeutic proteins, including both in in vitro and in vivo diagnostic and therapeutic methods. For example, the antibodies have utility in immunoassays for qualitatively and quantitatively measuring levels of the Therapeutic protein in biological samples. See, e.g., Harlow et al., Antibodies: A Laboratory Manual, (Cold Spring Harbor Laboratory Press, 2nd ed. 1988); incorporated by reference herein in its entirety. Likewise, albumin fusion proteins comprising at least a fragment or variant of an antibody that binds a Therapeutic protein, may be used, for example, to purify, detect, and target Therapeutic proteins, including both in vitro and in vivo diagnostic and therapeutic methods.

Antibodies that bind to a Therapeutic protein and that may correspond to a Therapeutic protein portion of an albumin fusion protein include derivatives that are modified, i.e., by the covalent attachment of any type of molecule to the antibody. For example, but not by way of limitation, the antibody derivatives include antibodies that have been modified, e.g., by glycosylation, acetylation, pegylation, phosphorylation, amidation, derivatization by known protecting/blocking groups, proteolytic cleavage, linkage to a cellular ligand or other protein, etc. Any of numerous chemical modifications may be carried out by known techniques, including, but not limited to specific chemical cleavage, acetylation, formylation, metabolic synthesis of tunicamycin, etc. Additionally, the derivative may contain one or more non-classical amino acids. Albumin fusion proteins of the invention may also be modified as described above.

Methods of Producing Antibodies that Bind Therapeutic Proteins

The antibodies that bind to a Therapeutic protein and that may correspond to a Therapeutic protein portion of an albumin fusion protein of the invention may be generated by any suitable method known in the art. Polyclonal antibodies to an antigen-of-interest can be produced by various procedures well known in the art. For example, a Therapeutic protein may be administered to various host animals including, but not limited to, rabbits, mice, rats, etc. to induce the production of sera containing polyclonal antibodies specific for the antigen. Various adjuvants may be used to increase the immunological response, depending on the host species, and include but are not limited to, Freund's (complete and incomplete), mineral gels such as aluminum hydroxide, surface active substances such as lysolecithin, pluronic polyols, polyanions, peptides, oil emulsions, keyhole limpet hemocyanins, dinitrophenol, and potentially useful human adjuvants such as BCG (bacille Calmette-Guerin) and *corynebacterium parvum*. Such adjuvants are also well known in the art.

Monoclonal antibodies can be prepared using a wide variety of techniques known in the art including the use of hybridoma, recombinant, and phage display technologies, or a combination thereof. For example, monoclonal antibodies can be produced using hybridoma techniques including those known in the art and taught, for example, in Harlow et al., Antibodies: A Laboratory Manual, (Cold Spring Harbor Laboratory Press, 2nd ed. 1988); Hammerling, et al., in: Monoclonal Antibodies and T-Cell Hybridomas 563-681 (Elsevier, N.Y., 1981) (said references incorporated by reference in their entireties). The term "monoclonal antibody" as used herein is not limited to antibodies produced through hybridoma technology. The term "monoclonal antibody" refers to an antibody that is derived from a single clone, including any eukaryotic, prokaryotic, or phage clone, and not the method by which it is produced.

Methods for producing and screening for specific antibodies using hybridoma technology are routine and well known in the art. In a non-limiting example, mice can be immunized with a Therapeutic protein or fragment or variant thereof, an albumin fusion protein, or a cell expressing such a Therapeutic protein or fragment or variant thereof or albumin fusion protein. Once an immune response is detected, e.g., antibodies specific for the antigen are detected in the mouse serum, the mouse spleen is harvested and splenocytes isolated. The splenocytes are then fused by well known techniques to any suitable myeloma cells, for example cells from cell line SP20 available from the ATCC™. Hybridomas are selected and cloned by limited dilution. The hybridoma clones are then assayed by methods known in the art for cells that secrete antibodies capable of binding a polypeptide of the invention. Ascites fluid, which generally contains high levels of antibodies, can be generated by immunizing mice with positive hybridoma clones.

Accordingly, the present invention provides methods of generating monoclonal antibodies as well as antibodies produced by the method comprising culturing a hybridoma cell secreting an antibody wherein, preferably, the hybridoma is generated by fusing splenocytes isolated from a mouse immunized with an antigen of the invention with myeloma cells and then screening the hybridomas resulting from the fusion for hybridoma clones that secrete an antibody able to bind a polypeptide of the invention.

Another well known method for producing both polyclonal and monoclonal human B cell lines is transformation using Epstein Barr Virus (EBV). Protocols for generating EBV-transformed B cell lines are commonly known in the art, such as, for example, the protocol outlined in Chapter 7.22 of Current Protocols in Immunology, Coligan et al., Eds., 1994, John Wiley & Sons, NY, which is hereby incorporated in its entirety by reference. The source of B cells for transformation is commonly human peripheral blood, but B cells for transformation may also be derived from other sources including, but not limited to, lymph nodes, tonsil, spleen, tumor tissue, and infected tissues. Tissues are generally made into single cell suspensions prior to EBV transformation. Additionally, steps may be taken to either physically remove or inactivate T cells (e.g., by treatment with cyclosporin A) in B cell-containing samples, because T cells from individuals seropositive for anti-EBV antibodies can suppress B cell immortalization by EBV.

In general, the sample containing human B cells is innoculated with EBV, and cultured for 3-4 weeks. A typical source of EBV is the culture supernatant of the B95-8 cell line (ATCC™ #VR-1492). Physical signs of EBV transformation can generally be seen towards the end of the 3-4 week culture period. By phase-contrast microscopy, transformed cells may appear large, clear, hairy and tend to aggregate in tight clusters of cells. Initially, EBV lines are generally polyclonal. However, over prolonged periods of cell cultures, EBV lines may become monoclonal or polyclonal as a result of the selective outgrowth of particular B cell clones. Alternatively, polyclonal EBV transformed lines may be subcloned (e.g., by limiting dilution culture) or fused with a suitable fusion partner and plated at limiting dilution to obtain monoclonal B cell lines. Suitable fusion partners for EBV transformed cell lines include mouse myeloma cell lines (e.g., SP2/0, X63-Ag8.653), heteromyeloma cell lines (human×mouse; e.g, SPAM-8, SBC-H20, and CB-F7), and human cell lines (e.g., GM 1500, SKO-007, RPMI 8226, and KR-4). Thus, the present invention also provides a method of generating polyclonal or monoclonal human antibodies against polypeptides of the invention or fragments thereof, comprising EBV-transformation of human B cells.

Antibody fragments which recognize specific epitopes may be generated by known techniques. For example, Fab and F(ab')2 fragments of the invention may be produced by proteolytic cleavage of immunoglobulin molecules, using enzymes such as papain (to produce Fab fragments) or pepsin (to produce F(ab')2 fragments). F(ab')2 fragments contain the variable region, the light chain constant region and the CH1 domain of the heavy chain.

For example, antibodies that bind to a Therapeutic protein can also be generated using various phage display methods known in the art. In phage display methods, functional antibody domains are displayed on the surface of phage particles which carry the polynucleotide sequences encoding them. In a particular embodiment, such phage can be utilized to display antigen binding domains expressed from a repertoire or combinatorial antibody library (e.g., human or murine). Phage expressing an antigen binding domain that binds the antigen of interest can be selected or identified with antigen, e.g., using labeled antigen or antigen bound or captured to a solid surface or bead. Phage used in these methods are typically filamentous phage including fd and M13 binding domains expressed from phage with Fab, Fv or disulfide stabilized Fv antibody domains recombinantly fused to either the phage gene III or gene VIII protein. Examples of phage display methods that can be used to make antibodies that bind to a Therapeutic protein include those disclosed in Brinkman et al., J. Immunol. Methods 182:41-50 (1995); Ames et al., J. Immunol. Methods 184:177-186 (1995); Kettleborough et al., Eur. J. Immunol. 24:952-958 (1994); Persic et al., Gene 187 9-18 (1997); Burton et al., Advances in Immunology 57:191-280 (1994); PCT application No. PCT/GB91/01134; PCT publications WO 90/02809; WO 91/10737; WO 92/01047; WO 92/18619; WO 93/11236; WO 95/15982; WO 95/20401; and U.S. Pat. Nos. 5,698,426; 5,223,409; 5,403,484; 5,580,717; 5,427,908; 5,750,753; 5,821,047; 5,571,698; 5,427,908; 5,516,637; 5,780,225; 5,658,727; 5,733,743 and 5,969,108; each of which is incorporated herein by reference in its entirety.

As described in the above references, after phage selection, the antibody coding regions from the phage can be isolated and used to generate whole antibodies, including human antibodies, or any other desired antigen binding fragment, and expressed in any desired host, including mammalian cells, insect cells, plant cells, yeast, and bacteria, e.g., as described in detail below. For example, techniques to recombinantly produce Fab, Fab' and F(ab')2 fragments can also be employed using methods known in the art such as those disclosed in PCT publication WO 92/22324; Mullinax et al., BioTechniques 12(6):864-869 (1992); and Sawai et al., AJRI 34:26-34 (1995); and Better et al., Science 240:1041-1043 (1988) (said references incorporated by reference in their entireties).

Examples of techniques which can be used to produce single-chain Fvs and antibodies include those described in U.S. Pat. Nos. 4,946,778 and 5,258,498; Huston et al., Methods in Enzymology 203:46-88 (1991); Shu et al., PNAS 90:7995-7999 (1993); and Skerra et al., Science 240:1038-1040 (1988). For some uses, including in vivo use of antibodies in humans and in vitro detection assays, it may be preferable to use chimeric, humanized, or human antibodies. A chimeric antibody is a molecule in which different portions of the antibody are derived from different animal species, such as antibodies having a variable region derived from a murine monoclonal antibody and a human immunoglobulin constant region. Methods for producing chimeric antibodies are known in the art. See e.g., Morrison, Science 229:1202 (1985); Oi et al., BioTechniques 4:214 (1986); Gillies et al., (1989) J. Immunol. Methods 125:191-202; U.S. Pat. Nos. 5,807,715; 4,816,567; and 4,816,397, which are incorporated herein by reference in their entirety. Humanized antibodies are antibody molecules from non-human species antibody that binds the desired antigen having one or more complementarity determining regions (CDRs) from the non-human species and a framework regions from a human immunoglobulin molecule. Often, framework residues in the human framework regions will be substituted with the corresponding residue from the CDR donor antibody to alter, preferably improve, antigen binding. These framework substitutions are identified by methods well known in the art, e.g., by modeling of the interactions of the CDR and framework residues to identify framework residues important for antigen binding and sequence comparison to identify unusual framework residues at particular positions. (See, e.g., Queen et al., U.S. Pat. No. 5,585,089; Riechmann et al., Nature 332:323 (1988), which are incorporated herein by reference in their entireties.) Antibodies can be humanized using a variety of techniques known in the art including, for example, CDR-grafting (EP 239,400; PCT publication WO 91/09967; U.S. Pat. Nos. 5,225,539; 5,530,101; and 5,585,089), veneering or resurfacing (EP 592,106; EP 519,596; Padlan, Molecular Immunology 28(4/5):489-498 (1991); Studnicka et al., Protein Engineering 7(6):805-814 (1994); Roguska. et al., PNAS 91:969-973 (1994)), and chain shuffling (U.S. Pat. No. 5,565,332).

Completely human antibodies are particularly desirable for therapeutic treatment of human patients. Human antibodies can be made by a variety of methods known in the art including phage display methods described above using antibody libraries derived from human immunoglobulin sequences. See also, U.S. Pat. Nos. 4,444,887 and 4,716,111; and PCT publications WO 98/46645, WO 98/50433, WO 98/24893, WO 98/16654, WO 96/34096, WO 96/33735, and WO 91/10741; each of which is incorporated herein by reference in its entirety.

Human antibodies can also be produced using transgenic mice which are incapable of expressing functional endogenous immunoglobulins, but which can express human immunoglobulin genes. For example, the human heavy and light chain immunoglobulin gene complexes may be introduced randomly or by homologous recombination into mouse embryonic stem cells. Alternatively, the human variable region, constant region, and diversity region may be introduced into mouse embryonic stem cells in addition to the human heavy and light chain genes. The mouse heavy and light chain immunoglobulin genes may be rendered non-functional separately or simultaneously with the introduction of human immunoglobulin loci by homologous recombination. In particular, homozygous deletion of the JH region prevents endogenous antibody production. The modified embryonic stem cells are expanded and microinjected into blastocysts to produce chimeric mice. The chimeric mice are then bred to produce homozygous offspring which express human antibodies. The transgenic mice are immunized in the normal fashion with a selected antigen, e.g., all or a portion of a polypeptide of the invention. Monoclonal antibodies directed against the antigen can be obtained from the immunized, transgenic mice using conventional hybridoma technology. The human immunoglobulin transgenes harbored by the transgenic mice rearrange during B cell differentiation, and subsequently undergo class switching and somatic mutation. Thus, using such a technique, it is possible to produce therapeutically useful IgG, IgA, IgM and IgE antibodies. For an overview of this technology for producing human antibodies, see Lonberg and Huszar, Int. Rev. Immunol. 13:65-93 (1995). For a detailed discussion of this technology for producing human antibodies and human monoclonal antibodies and protocols for producing such antibodies, see, e.g., PCT publications WO 98/24893; WO 92/01047; WO 96/34096; WO 96/33735; European Patent No. 0 598 877; U.S. Pat. Nos. 5,413,923; 5,625,126; 5,633,425; 5,569,825; 5,661,016; 5,545,806; 5,814,318; 5,885,793; 5,916,771; 5,939,598; 6,075,181; and 6,114,598, which are incorporated by reference herein in their entirety. In addition, companies such as Abgenix, Inc. (Freemont, Calif.) and Genpharm (San Jose, Calif.) can be engaged to provide human antibodies directed against a selected antigen using technology similar to that described above.

Completely human antibodies which recognize a selected epitope can be generated using a technique referred to as "guided selection." In this approach a selected non-human monoclonal antibody, e.g., a mouse antibody, is used to guide the selection of a completely human antibody recognizing the same epitope. (Jespers et al., Bio/technology 12:899-903 (1988)).

Polynucleotides Encoding Antibodies

The invention further provides polynucleotides comprising a nucleotide sequence encoding an antibody and fragments thereof. The invention also encompasses polynucleotides that hybridize under stringent or alternatively, under lower stringency hybridization conditions, e.g., as defined supra, to polynucleotides that encode an antibody, preferably, that specifically binds to a Therapeutic protein, and more preferably, an antibody that binds to a polypeptide having the amino acid sequence of a "Therapeutic protein:X" as disclosed in the "SEQ ID NO:Z" column of Table 2.

The polynucleotides may be obtained, and the nucleotide sequence of the polynucleotides determined, by any method known in the art. For example, if the nucleotide sequence of the antibody is known, a polynucleotide encoding the antibody may be assembled from chemically synthesized oligonucleotides (e.g., as described in Kutmeier et al., BioTechniques 17:242 (1994)), which, briefly, involves the synthesis of overlapping oligonucleotides containing portions of the sequence encoding the antibody, annealing and ligating of those oligonucleotides, and then amplification of the ligated oligonucleotides by PCR.

Alternatively, a polynucleotide encoding an antibody may be generated from nucleic acid from a suitable source. If a clone containing a nucleic acid encoding a particular antibody is not available, but the sequence of the antibody molecule is known, a nucleic acid encoding the immunoglobulin may be chemically synthesized or obtained from a suitable source (e.g., an antibody cDNA library, or a cDNA library generated from, or nucleic acid, preferably poly A+ RNA, isolated from, any tissue or cells expressing the antibody, such as hybridoma cells selected to express an antibody) by PCR amplification using synthetic primers hybridizable to the 3' and 5' ends of the sequence or by cloning using an oligonucleotide probe specific for the particular gene sequence to identify, e.g., a cDNA clone from a cDNA library that encodes the antibody. Amplified nucleic acids generated by PCR may then be cloned into replicable cloning vectors using any method well known in the art (See Example 65).

Once the nucleotide sequence and corresponding amino acid sequence of the antibody is determined, the nucleotide sequence of the antibody may be manipulated using methods well known in the art for the manipulation of nucleotide sequences, e.g., recombinant DNA techniques, site directed mutagenesis, PCR, etc. (see, for example, the techniques described in Sambrook et al., 1990, Molecular Cloning, A Laboratory Manual, 2d Ed., Cold Spring Harbor Laboratory, Cold Spring Harbor, N.Y. and Ausubel et al., eds., 1998, Current Protocols in Molecular Biology, John Wiley & Sons, NY, which are both incorporated by reference herein in their entireties), to generate antibodies having a different amino acid sequence, for example to create amino acid substitutions, deletions, and/or insertions.

In a specific embodiment, the amino acid sequence of the heavy and/or light chain variable domains may be inspected to identify the sequences of the complementarity determining regions (CDRs) by methods that are well know in the art, e.g., by comparison to known amino acid sequences of other heavy and light chain variable regions to determine the regions of sequence hypervariability. Using routine recombinant DNA techniques, one or more of the CDRs may be inserted within framework regions, e.g., into human framework regions to humanize a non-human antibody, as described supra. The framework regions may be naturally occurring or consensus framework regions, and preferably human framework regions (see, e.g., Chothia et al., J. Mol. Biol. 278: 457-479 (1998) for a listing of human framework regions). Preferably, the polynucleotide generated by the combination of the framework regions and CDRs encodes an antibody that specifically binds a polypeptide of the invention. Preferably, as discussed supra, one or more amino acid substitutions may be made within the framework regions, and, preferably, the amino acid substitutions improve binding of the antibody to its antigen. Additionally, such methods may be used to make amino acid substitutions or deletions of one or more variable region cysteine residues participating in an intrachain disulfide bond to generate antibody molecules lacking one or more intrachain disulfide bonds. Other alterations to the polynucleotide are encompassed by the present invention and within the skill of the art.

In addition, techniques developed for the production of "chimeric antibodies" (Morrison et al., Proc. Natl. Acad. Sci. 81:851-855 (1984); Neuberger et al., Nature 312:604-608 (1984); Takeda et al., Nature 314:452-454 (1985)) by splicing genes from a mouse antibody molecule of appropriate antigen specificity together with genes from a human antibody molecule of appropriate biological activity can be used. As described supra, a chimeric antibody is a molecule in which different portions are derived from different animal species, such as those having a variable region derived from a murine mAb and a human immunoglobulin constant region, e.g., humanized antibodies.

Alternatively, techniques described for the production of single chain antibodies (U.S. Pat. No. 4,946,778; Bird, Science 242:423-42 (1988); Huston et al., Proc. Natl. Acad. Sci. USA 85:5879-5883 (1988); and Ward et al., Nature 334:544-

54 (1989)) can be adapted to produce single chain antibodies. Single chain antibodies are formed by linking the heavy and light chain fragments of the Fv region via an amino acid bridge, resulting in a single chain polypeptide. Techniques for the assembly of functional Fv fragments in *E. coli* may also be used (Skerra et al., Science 242:1038-1041 (1988)).

Recombinant Expression of Antibodies

Recombinant expression of an antibody, or fragment, derivative or analog thereof, (e.g., a heavy or light chain of an antibody or a single chain antibody), requires construction of an expression vector containing a polynucleotide that encodes the antibody. Once a polynucleotide encoding an antibody molecule or a heavy or light chain of an antibody, or portion thereof (preferably containing the heavy or light chain variable domain), of the invention has been obtained, the vector for the production of the antibody molecule may be produced by recombinant DNA technology using techniques well known in the art. Thus, methods for preparing a protein by expressing a polynucleotide containing an antibody encoding nucleotide sequence are described herein. Methods which are well known to those skilled in the art can be used to construct expression vectors containing antibody coding sequences and appropriate transcriptional and translational control signals. These methods include, for example, in vitro recombinant DNA techniques, synthetic techniques, and in vivo genetic recombination. The invention, thus, provides replicable vectors comprising a nucleotide sequence encoding an antibody molecule of the invention, or a heavy or light chain thereof, or a heavy or light chain variable domain, operably linked to a promoter. Such vectors may include the nucleotide sequence encoding the constant region of the antibody molecule (see, e.g., PCT Publication WO 86/05807; PCT Publication WO 89/01036; and U.S. Pat. No. 5,122,464) and the variable domain of the antibody may be cloned into such a vector for expression of the entire heavy or light chain.

The expression vector is transferred to a host cell by conventional techniques and the transfected cells are then cultured by conventional techniques to produce an antibody. Thus, the invention includes host cells containing a polynucleotide encoding an antibody of the invention, or a heavy or light chain thereof, or a single chain antibody, operably linked to a heterologous promoter. In preferred embodiments for the expression of double-chained antibodies, vectors encoding both the heavy and light chains may be co-expressed in the host cell for expression of the entire immunoglobulin molecule, as detailed below.

A variety of host-expression vector systems may be utilized to express the antibody molecules of the invention. Such host-expression systems represent vehicles by which the coding sequences of interest may be produced and subsequently purified, but also represent cells which may, when transformed or transfected with the appropriate nucleotide coding sequences, express an antibody molecule of the invention in situ. These include but are not limited to microorganisms such as bacteria (e.g., *E. coli, B. subtilis*) transformed with recombinant bacteriophage DNA, plasmid DNA or cosmid DNA expression vectors containing antibody coding sequences; yeast (e.g., *Saccharomyces, Pichia*) transformed with recombinant yeast expression vectors containing antibody coding sequences; insect cell systems infected with recombinant virus expression vectors (e.g., baculovirus) containing antibody coding sequences; plant cell systems infected with recombinant virus expression vectors (e.g., cauliflower mosaic virus, CaMV; tobacco mosaic virus, TMV) or transformed with recombinant plasmid expression vectors (e.g., Ti plasmid) containing antibody coding sequences; or mammalian cell systems (e.g., COS, CHO, BHK, 293, 3T3 cells) harboring recombinant expression constructs containing promoters derived from the genome of mammalian cells (e.g., metallothionein promoter) or from mammalian viruses (e.g., the adenovirus late promoter; the vaccinia virus 7.5K promoter). Preferably, bacterial cells such as *Escherichia coli*, and more preferably, eukaryotic cells, especially for the expression of whole recombinant antibody molecule, are used for the expression of a recombinant antibody molecule. For example, mammalian cells such as Chinese hamster ovary cells (CHO), in conjunction with a vector such as the major intermediate early gene promoter element from human cytomegalovirus is an effective expression system for antibodies (Foecking et al., Gene 45:101 (1986); Cockett et al., Bio/Technology 8:2 (1990)).

In bacterial systems, a number of expression vectors may be advantageously selected depending upon the use intended for the antibody molecule being expressed. For example, when a large quantity of such a protein is to be produced, for the generation of pharmaceutical compositions of an antibody molecule, vectors which direct the expression of high levels of fusion protein products that are readily purified may be desirable. Such vectors include, but are not limited, to the *E. coli* expression vector pUR278 (Ruther et al., EMBO J. 2:1791 (1983)), in which the antibody coding sequence may be ligated individually into the vector in frame with the lac Z coding region so that a fusion protein is produced; pIN vectors (Inouye & Inouye, Nucleic Acids Res. 13:3101-3109 (1985); Van Heeke & Schuster, J. Biol. Chem. 24:5503-5509 (1989)); and the like. pGEX vectors may also be used to express foreign polypeptides as fusion proteins with glutathione S-transferase (GST). In general, such fusion proteins are soluble and can easily be purified from lysed cells by adsorption and binding to matrix glutathione-agarose beads followed by elution in the presence of free glutathione. The pGEX vectors are designed to include thrombin or factor Xa protease cleavage sites so that the cloned target gene product can be released from the GST moiety.

In an insect system, *Autographa californica* nuclear polyhedrosis virus (AcNPV) is used as a vector to express foreign genes. The virus grows in *Spodoptera frugiperda* cells. The antibody coding sequence may be cloned individually into non-essential regions (for example the polyhedrin gene) of the virus and placed under control of an AcNPV promoter (for example the polyhedrin promoter).

In mammalian host cells, a number of viral-based expression systems may be utilized. In cases where an adenovirus is used as an expression vector, the antibody coding sequence of interest may be ligated to an adenovirus transcription/translation control complex, e.g., the late promoter and tripartite leader sequence. This chimeric gene may then be inserted in the adenovirus genome by in vitro or in vivo recombination. Insertion in a non-essential region of the viral genome (e.g., region E1 or E3) will result in a recombinant virus that is viable and capable of expressing the antibody molecule in infected hosts. (e.g., see Logan & Shenk, Proc. Natl. Acad. Sci. USA 81:355-359 (1984)). Specific initiation signals may also be required for efficient translation of inserted antibody coding sequences. These signals include the ATG initiation codon and adjacent sequences. Furthermore, the initiation codon must be in phase with the reading frame of the desired coding sequence to ensure translation of the entire insert. These exogenous translational control signals and initiation codons can be of a variety of origins, both natural and synthetic. The efficiency of expression may be enhanced by the inclusion of appropriate transcription enhancer elements, transcription terminators, etc. (see Bittner et al., Methods in Enzymol. 153:51-544 (1987)).

In addition, a host cell strain may be chosen which modulates the expression of the inserted sequences, or modifies and processes the gene product in the specific fashion desired. Such modifications (e.g., glycosylation) and processing (e.g., cleavage) of protein products may be important for the function of the protein. Different host cells have characteristic and specific mechanisms for the post-translational processing and modification of proteins and gene products. Appropriate cell lines or host systems can be chosen to ensure the correct modification and processing of the foreign protein expressed. To this end, eukaryotic host cells which possess the cellular machinery for proper processing of the primary transcript, glycosylation, and phosphorylation of the gene product may be used. Such mammalian host cells include but are not limited to CHO, VERY, BHK, Hela, COS, MDCK, 293, 3T3, WI38, and in particular, breast cancer cell lines such as, for example, BT483, Hs578T, HTB2, BT20 and T47D, and normal mammary gland cell line such as, for example, CRL7030 and Hs578Bst.

For long-term, high-yield production of recombinant proteins, stable expression is preferred. For example, cell lines which stably express the antibody molecule may be engineered. Rather than using expression vectors which contain viral origins of replication, host cells can be transformed with DNA controlled by appropriate expression control elements (e.g., promoter, enhancer, sequences, transcription terminators, polyadenylation sites, etc.), and a selectable marker. Following the introduction of the foreign DNA, engineered cells may be allowed to grow for 1-2 days in an enriched media, and then are switched to a selective media. The selectable marker in the recombinant plasmid confers resistance to the selection and allows cells to stably integrate the plasmid into their chromosomes and grow to form foci which in turn can be cloned and expanded into cell lines. This method may advantageously be used to engineer cell lines which express the antibody molecule. Such engineered cell lines may be particularly useful in screening and evaluation of compounds that interact directly or indirectly with the antibody molecule.

A number of selection systems may be used, including but not limited to the herpes simplex virus thymidine kinase (Wigler et al., Cell 11:223 (1977)), hypoxanthine-guanine phosphoribosyltransferase (Szybalska & Szybalski, Proc. Natl. Acad. Sci. USA 48:202 (1992)), and adenine phosphoribosyltransferase (Lowy et al., Cell 22:817 (1980)) genes can be employed in tk−, hgprt− or aprt− cells, respectively. Also, antimetabolite resistance can be used as the basis of selection for the following genes: dhfr, which confers resistance to methotrexate (Wigler et al., Natl. Acad. Sci. USA 77:357 (1980); O'Hare et al., Proc. Natl. Acad. Sci. USA 78:1527 (1981)); gpt, which confers resistance to mycophenolic acid (Mulligan & Berg, Proc. Natl. Acad. Sci. USA 78:2072 (1981)); neo, which confers resistance to the aminoglycoside G-418 Clinical Pharmacy 12:488-505; Wu and Wu, Biotherapy 3:87-95 (1991); Tolstoshev, Ann. Rev. Pharmacol. Toxicol. 32:573-596 (1993); Mulligan, Science 260:926-932 (1993); and Morgan and Anderson, Ann. Rev. Biochem. 62:191-217 (1993); May, 1993, TIB TECH 11(5):155-215 (1993)); and hygro, which confers resistance to hygromycin (Santerre et al., Gene 30:147 (1984)). Methods commonly known in the art of recombinant DNA technology may be routinely applied to select the desired recombinant clone, and such methods are described, for example, in Ausubel et al. (eds.), Current Protocols in Molecular Biology, John Wiley & Sons, NY (1993); Kriegler, Gene Transfer and Expression, A Laboratory Manual, Stockton Press, NY (1990); and in Chapters 12 and 13, Dracopoli et al. (eds), Current Protocols in Human Genetics, John Wiley & Sons, NY (1994); Colberre-Garapin et al., J. Mol. Biol. 150:1 (1981), which are incorporated by reference herein in their entireties.

The expression levels of an antibody molecule can be increased by vector amplification (for a review, see Bebbington and Hentschel, The use of vectors based on gene amplification for the expression of cloned genes in mammalian cells in DNA cloning, Vol. 3. (Academic Press, New York, 1987)). When a marker in the vector system expressing antibody is amplifiable, increase in the level of inhibitor present in culture of host cell will increase the number of copies of the marker gene. Since the amplified region is associated with the antibody gene, production of the antibody will also increase (Crouse et al., Mol. Cell. Biol. 3:257 (1983)).

Vectors which use glutamine synthase (GS) or DHFR as the selectable markers can be amplified in the presence of the drugs methionine sulphoximine or methotrexate, respectively. An advantage of glutamine synthase based vectors are the availability of cell lines (e.g., the murine myeloma cell line, NS0) which are glutamine synthase negative. Glutamine synthase expression systems can also function in glutamine synthase expressing cells (e.g. Chinese Hamster Ovary (CHO) cells) by providing additional inhibitor to prevent the functioning of the endogenous gene. A glutamine synthase expression system and components thereof are detailed in PCT publications: WO87/04462; WO86/05807; WO89/01036; WO89/10404; and WO91/06657 which are incorporated in their entireties by reference herein. Additionally, glutamine synthase expression vectors that may be used according to the present invention are commercially available from suppliers, including, for example Lonza Biologics, Inc. (Portsmouth, N.H.). Expression and production of monoclonal antibodies using a GS expression system in murine myeloma cells is described in Bebbington et al., *Bio/technology* 10:169 (1992) and in Biblia and Robinson *Biotechnol. Prog.* 11:1(1995) which are incorporated in their entireties by reference herein.

The host cell may be co-transfected with two expression vectors of the invention, the first vector encoding a heavy chain derived polypeptide and the second vector encoding a light chain derived polypeptide. The two vectors may contain identical selectable markers which enable equal expression of heavy and light chain polypeptides. Alternatively, a single vector may be used which encodes, and is capable of expressing, both heavy and light chain polypeptides. In such situations, the light chain should be placed before the heavy chain to avoid an excess of toxic free heavy chain (Proudfoot, Nature 322:52 (1986); Kohler, Proc. Natl. Acad. Sci. USA 77:2197 (1980)). The coding sequences for the heavy and light chains may comprise cDNA or genomic DNA.

Once an antibody molecule of the invention has been produced by an animal, chemically synthesized, or recombinantly expressed, it may be purified by any method known in the art for purification of an immunoglobulin molecule, for example, by chromatography (e.g., ion exchange, affinity, particularly by affinity for the specific antigen after Protein A, and sizing column chromatography), centrifugation, differential solubility, or by any other standard technique for the purification of proteins. In addition, the antibodies that bind to a Therapeutic protein and that may correspond to a Therapeutic protein portion of an albumin fusion protein of the invention or fragments thereof can be fused to heterologous polypeptide sequences described herein or otherwise known in the art, to facilitate purification.

Modifications of Antibodies

Antibodies that bind a Therapeutic protein or fragments or variants can be fused to marker sequences, such as a peptide to facilitate purification. In preferred embodiments, the marker amino acid sequence is a hexa-histidine peptide, such as the tag provided in a pQE vector (QIAGEN, Inc., 9259 Eton Avenue, Chatsworth, Calif., 91311), among others, many of which are commercially available. As described in Gentz et al., Proc. Natl. Acad. Sci. USA 86:821-824 (1989), for instance, hexa-histidine provides for convenient purification of the fusion protein. Other peptide tags useful for purification include, but are not limited to, the hemagglutinin tag (also called the "HA tag"), which corresponds to an epitope derived from the influenza hemagglutinin protein (Wilson et al., Cell 37:767 (1984)) and the "flag" tag.

The present invention further encompasses antibodies or fragments thereof conjugated to a diagnostic or therapeutic agent. The antibodies can be used diagnostically to, for example, monitor the development or progression of a tumor as part of a clinical testing procedure to, e.g., determine the efficacy of a given treatment regimen. Detection can be facilitated by coupling the antibody to a detectable substance. Examples of detectable substances include various enzymes, prosthetic groups, fluorescent materials, luminescent materials, bioluminescent materials, radioactive materials, positron emitting metals using various positron emission tomographies, and nonradioactive paramagnetic metal ions. The detectable substance may be coupled or conjugated either directly to the antibody (or fragment thereof) or indirectly, through an intermediate (such as, for example, a linker known in the art) using techniques known in the art. See, for example, U.S. Pat. No. 4,741,900 for metal ions which can be conjugated to antibodies for use as diagnostics according to the present invention. Examples of suitable enzymes include horseradish peroxidase, alkaline phosphatase, beta-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin; and examples of suitable radioactive material include 125I, 131I, 111In or 99Tc. Other examples of detectable substances have been described elsewhere herein.

Further, an antibody of the invention may be conjugated to a therapeutic moiety such as a cytotoxin, e.g., a cytostatic or cytocidal agent, a therapeutic agent or a radioactive metal ion, e.g., alpha-emitters such as, for example, 213Bi. A cytotoxin or cytotoxic agent includes any agent that is detrimental to cells. Examples include paclitaxol, cytochalasin B, gramicidin D, ethidium bromide, emetine, mitomycin, etoposide, tenoposide, vincristine, vinblastine, colchicin, doxorubicin, daunorubicin, dihydroxy anthracin dione, mitoxantrone, mithramycin, actinomycin D, 1-dehydrotestosterone, glucocorticoids, procaine, tetracaine, lidocaine, propranolol, and puromycin and analogs or homologs thereof. Therapeutic agents include, but are not limited to, antimetabolites (e.g., methotrexate, 6-mercaptopurine, 6-thioguanine, cytarabine, 5-fluorouracil decarbazine), alkylating agents (e.g., mechlorethamine, thioepa chlorambucil, melphalan, carmustine (BSNU) and lomustine (CCNU), cyclothosphamide, busulfan, dibromomannitol, streptozotocin, mitomycin C, and cis-dichlorodiamine platinum (II) (DDP) cisplatin), anthracyclines (e.g., daunorubicin (formerly daunomycin) and doxorubicin), antibiotics (e.g., dactinomycin (formerly actinomycin), bleomycin, mithramycin, and anthramycin (AMC)), and anti-mitotic agents (e.g., vincristine and vinblastine).

The conjugates of the invention can be used for modifying a given biological response, the therapeutic agent or drug moiety is not to be construed as limited to classical chemical therapeutic agents. For example, the drug moiety may be a protein or polypeptide possessing a desired biological activity. Such proteins may include, for example, a toxin such as abrin, ricin A, pseudomonas exotoxin, or diphtheria toxin; a protein such as tumor necrosis factor, alpha-interferon, β-interferon, nerve growth factor, platelet derived growth factor, tissue plasminogen activator, an apoptotic agent, e.g., TNF-alpha, TNF-beta, AIM I (See, International Publication No. WO 97/33899), AIM II (See, International Publication No. WO 97/34911), Fas Ligand (Takahashi et al., *Int. Immunol.,* 6:1567-1574 (1994)), VEGI (See, International Publication No. WO 99/23105), a thrombotic agent or an anti-angiogenic agent, e.g., angiostatin or endostatin; or, biological response modifiers such as, for example, lymphokines, interleukin-1 ("IL-1"), interleukin-2 ("IL-2"), interleukin-6 ("IL-6"), granulocyte macrophage colony stimulating factor ("GM-CSF"), granulocyte colony stimulating factor ("G-CSF"), or other growth factors.

Antibodies may also be attached to solid supports, which are particularly useful for immunoassays or purification of the target antigen. Such solid supports include, but are not limited to, glass, cellulose, polyacrylamide, nylon, polystyrene, polyvinyl chloride or polypropylene.

Techniques for conjugating such therapeutic moiety to antibodies are well known. See, for example, Amon et al., "Monoclonal Antibodies For Immunotargeting Of Drugs In Cancer Therapy", in Monoclonal Antibodies And Cancer Therapy, Reisfeld et al. (eds.), pp. 243-56 (Alan R. Liss, Inc. 1985); Hellstrom et al., "Antibodies For Drug Delivery", in Controlled Drug Delivery (2nd Ed.), Robinson et al. (eds.), pp. 623-53 (Marcel Dekker, Inc. 1987); Thorpe, "Antibody Carriers Of Cytotoxic Agents In Cancer Therapy: A Review", in Monoclonal Antibodies '84: Biological And Clinical Applications, Pinchera et al. (eds.), pp. 475-506 (1985); "Analysis, Results, And Future Prospective Of The Therapeutic Use Of Radiolabeled Antibody In Cancer Therapy", in Monoclonal Antibodies For Cancer Detection And Therapy, Baldwin et al. (eds.), pp. 303-16 (Academic Press 1985), and Thorpe et al., "The Preparation And Cytotoxic Properties Of Antibody-Toxin Conjugates", Immunol. Rev. 62:119-58 (1982).

Alternatively, an antibody can be conjugated to a second antibody to form an antibody heteroconjugate as described by Segal in U.S. Pat. No. 4,676,980, which is incorporated herein by reference in its entirety.

An antibody, with or without a therapeutic moiety conjugated to it, administered alone or in combination with cytotoxic factor(s) and/or cytokine(s) can be used as a therapeutic.

Antibody-Albumin Fusion

Antibodies that bind to a Therapeutic protein and that may correspond to a Therapeutic protein portion of an albumin fusion protein of the invention include, but are not limited to, antibodies that bind a Therapeutic protein disclosed in the "Therapeutic Protein X" column of Table 1, or a fragment or variant thereof.

In specific embodiments, the fragment or variant of an antibody that immunospecifically binds a Therapeutic protein and that corresponds to a Therapeutic protein portion of an albumin fusion protein comprises, or alternatively consists of, the VH domain. In other embodiments, the fragment or variant of an antibody that immunospecifically binds a Therapeutic protein and that corresponds to a Therapeutic protein portion of an albumin fusion protein comprises, or alternatively consists of, one, two or three VH CDRs. In other embodiments, the fragment or variant of an antibody that immunospecifically binds a Therapeutic protein and that corresponds to a Therapeutic protein portion of an albumin fusion protein comprises, or alternatively consists of, the VH CDR1. In other embodiments, the fragment or variant of an antibody that immunospecifically binds a Therapeutic protein and that corresponds to a Therapeutic protein portion of an albumin fusion protein comprises, or alternatively consists of, the VH CDR2. In other embodiments, the fragment or variant of an antibody that immunospecifically binds a Therapeutic protein and that corresponds to a Therapeutic protein portion of an albumin fusion protein comprises, or alternatively consists of, the VH CDR3.

In specific embodiments, the fragment or variant of an antibody that immunospecifically binds a Therapeutic protein and that corresponds to a Therapeutic protein portion of an albumin fusion protein comprises, or alternatively consists of, the VL domain. In other embodiments, the fragment or variant of an antibody that immunospecifically binds a Therapeutic protein and that corresponds to a Therapeutic protein portion of an albumin fusion protein comprises, or alternatively consists of, one, two or three VL CDRs. In other embodiments, the fragment or variant of an antibody that immunospecifically binds a Therapeutic protein and that corresponds to a Therapeutic protein portion of an albumin fusion protein comprises, or alternatively consists of, the VL CDR1. In other embodiments, the fragment or variant of an antibody that immunospecifically binds a Therapeutic protein and that corresponds to a Therapeutic protein portion of an albumin fusion protein comprises, or alternatively consists of, the VL CDR2. In other embodiments, the fragment or variant of an antibody that immunospecifically binds a Therapeutic protein and that corresponds to a Therapeutic protein portion of an albumin fusion protein comprises, or alternatively consists of, the VL CDR3.

In other embodiments, the fragment or variant of an antibody that immunospecifically binds a Therapeutic protein and that corresponds to a Therapeutic protein portion of an albumin fusion protein comprises, or alternatively consists of, one, two, three, four, five, or six VH and/or VL CDRs.

In preferred embodiments, the fragment or variant of an antibody that immunospecifically binds a Therapeutic protein and that corresponds to a Therapeutic protein portion of an albumin fusion protein comprises, or alternatively consists of, an scFv comprising the VH domain of the Therapeutic antibody, linked to the VL domain of the therapeutic antibody by a peptide linker such as $(Gly_4Ser)_3$ (SEQ ID NO:4).

Immunophenotyping

The antibodies of the invention or albumin fusion proteins of the invention comprising at least a fragment or variant of an antibody that binds a Therapeutic protein (or fragment or variant thereof) may be utilized for immunophenotyping of cell lines and biological samples. Therapeutic proteins of the present invention may be useful as cell-specific markers, or more specifically as cellular markers that are differentially expressed at various stages of differentiation and/or maturation of particular cell types. Monoclonal antibodies (or albumin fusion proteins comprising at least a fragment or variant of an antibody that binds a Therapeutic protein) directed against a specific epitope, or combination of epitopes, will allow for the screening of cellular populations expressing the marker. Various techniques can be utilized using monoclonal antibodies (or albumin fusion proteins comprising at least a fragment or variant of an antibody that binds a Therapeutic protein) to screen for cellular populations expressing the marker(s), and include magnetic separation using antibody-coated magnetic beads, "panning" with antibody attached to a solid matrix (i.e., plate), and flow cytometry (See, e.g., U.S. Pat. No. 5,985,660; and Morrison et al., *Cell,* 96:737-49 (1999)).

These techniques allow for the screening of particular populations of cells, such as might be found with hematological malignancies (i.e. minimal residual disease (MRD) in acute leukemic patients) and "non-self" cells in transplantations to prevent Graft-versus-Host Disease (GVHD). Alternatively, these techniques allow for the screening of hematopoietic stem and progenitor cells capable of undergoing proliferation and/or differentiation, as might be found in human umbilical cord blood.

Characterizing Antibodies that Bind a Therapeutic Protein and Albumin Fusion Proteins Comprising a Fragment or Variant of an Antibody that Binds a Therapeutic Protein The antibodies of the invention or albumin fusion proteins of the invention comprising at least a fragment or variant of an antibody that binds a Therapeutic protein (or fragment or variant thereof) may be characterized in a variety of ways. In particular, Albumin fusion proteins of the invention comprising at least a fragment or variant of an antibody that binds a Therapeutic protein may be assayed for the ability to specifically bind to the same antigens specifically bound by the antibody that binds a Therapeutic protein corresponding to the antibody that binds a Therapeutic protein portion of the albumin fusion protein using techniques described herein or routinely modifying techniques known in the art.

Assays for the ability of the antibodies of the invention or albumin fusion proteins of the invention comprising at least a fragment or variant of an antibody that binds a Therapeutic protein (or fragment or variant thereof) to (specifically) bind a specific protein or epitope may be performed in solution (e.g., Houghten, Bio/Techniques 13:412-421 (1992)), on beads (e.g., Lam, Nature 354:82-84 (1991)), on chips (e.g., Fodor, Nature 364:555-556 (1993)), on bacteria (e.g., U.S. Pat. No. 5,223,409), on spores (e.g., U.S. Pat. Nos. 5,571,698; 5,403,484; and 5,223,409), on plasmids (e.g., Cull et al., Proc. Natl. Acad. Sci. USA 89:1865-1869 (1992)) or on phage (e.g., Scott and Smith, Science 249:386-390 (1990); Devlin, Science 249:404-406 (1990); Cwirla et al., Proc. Natl. Acad. Sci. USA 87:6378-6382 (1990); and Felici, J. Mol. Biol. 222:301-310 (1991)) (each of these references is incorporated herein in its entirety by reference). The antibodies of the invention or albumin fusion proteins of the invention comprising at least a fragment or variant of an antibody that binds a Therapeutic protein (or fragment or variant thereof) may also be assayed for their specificity and affinity for a specific protein or epitope using or routinely modifying techniques described herein or otherwise known in the art.

The albumin fusion proteins of the invention comprising at least a fragment or variant of an antibody that binds a Therapeutic protein may be assayed for cross-reactivity with other antigens (e.g., molecules that have sequence/structure conservation with the molecule(s) specifically bound by the antibody that binds a Therapeutic protein (or fragment or variant thereof) corresponding to the Therapeutic protein portion of the albumin fusion protein of the invention) by any method known in the art.

Immunoassays which can be used to analyze (immunospecific) binding and cross-reactivity include, but are not limited to, competitive and non-competitive assay systems using techniques such as western blots, radioimmunoassays, ELISA (enzyme linked immunosorbent assay), "sandwich" immunoassays, immunoprecipitation assays, precipitin reactions, gel diffusion precipitin reactions, immunodiffusion assays, agglutination assays, complement-fixation assays, immunoradiometric assays, fluorescent immunoassays, and protein A immunoassays, to name but a few. Such assays are routine and well known in the art (see, e.g., Ausubel et al, eds, 1994, Current Protocols in Molecular Biology, Vol. 1, John Wiley & Sons, Inc., New York, which is incorporated by reference herein in its entirety). Exemplary immunoassays are described briefly below (but are not intended by way of limitation).

Immunoprecipitation protocols generally comprise lysing a population of cells in a lysis buffer such as RIPA buffer (1% NP-40 or Triton X-100, 1% sodium deoxycholate, 0.1% SDS, 0.15 M NaCl, 0.01 M sodium phosphate at pH 7.2, 1% Trasylol) supplemented with protein phosphatase and/or protease inhibitors (e.g., EDTA, PMSF, aprotinin, sodium vanadate), adding an antibody of the invention or albumin fusion protein of the invention comprising at least a fragment or variant of an antibody that binds a Therapeutic protein (or fragment or variant thereof) to the cell lysate, incubating for a period of time (e.g., 1 to 4 hours) at 40 degrees C., adding protein A and/or protein G sepharose beads (or beads coated with an appropriate anti-idiotypic antibody or anti-albumin antibody in the case when an albumin fusion protein comprising at least a fragment or variant of a Therapeutic antibody) to the cell lysate, incubating for about an hour or more at 40 degrees C., washing the beads in lysis buffer and resuspending the beads in SDS/sample buffer. The ability of the antibody or albumin fusion protein of the invention to immunoprecipitate a particular antigen can be assessed by, e.g., western blot analysis. One of skill in the art would be knowledgeable as to the parameters that can be modified to increase the binding of the antibody or albumin fusion protein to an antigen and decrease the background (e.g., pre-clearing the cell lysate with sepharose beads). For further discussion regarding immunoprecipitation protocols see, e.g., Ausubel et al, eds, 1994, Current Protocols in Molecular Biology, Vol. 1, John Wiley & Sons, Inc., New York at 10.16.1.

Western blot analysis generally comprises preparing protein samples, electrophoresis of the protein samples in a polyacrylamide gel (e.g., 8%-20% SDS-PAGE depending on the molecular weight of the antigen), transferring the protein sample from the polyacrylamide gel to a membrane such as nitrocellulose, PVDF or nylon, blocking the membrane in blocking solution (e.g., PBS with 3% BSA or non-fat milk), washing the membrane in washing buffer (e.g., PBS-Tween 20), applying the antibody or albumin fusion protein of the invention (diluted in blocking buffer) to the membrane, washing the membrane in washing buffer, applying a secondary antibody (which recognizes the albumin fusion protein, e.g., an anti-human serum albumin antibody) conjugated to an enzymatic substrate (e.g., horseradish peroxidase or alkaline phosphatase) or radioactive molecule (e.g., $^{32}$P or $^{125}$I) diluted in blocking buffer, washing the membrane in wash buffer, and detecting the presence of the antigen. One of skill in the art would be knowledgeable as to the parameters that can be modified to increase the signal detected and to reduce the background noise. For further discussion regarding western blot protocols see, e.g., Ausubel et al, eds, 1994, Current Protocols in Molecular Biology, Vol. 1, John Wiley & Sons, Inc., New York at 10.8.1.

ELISAs comprise preparing antigen, coating the well of a 96-well microtiter plate with the antigen, washing away antigen that did not bind the wells, adding the antibody or albumin fusion protein (comprising at least a fragment or variant of an antibody that binds a Therapeutic protein) of the invention conjugated to a detectable compound such as an enzymatic substrate (e.g., horseradish peroxidase or alkaline phosphatase) to the wells and incubating for a period of time, washing away unbound or non-specifically bound albumin fusion proteins, and detecting the presence of the antibody or albumin fusion proteins specifically bound to the antigen coating the well. In ELISAs the antibody or albumin fusion protein does not have to be conjugated to a detectable compound; instead, a second antibody (which recognizes the antibody or albumin fusion protein, respectively) conjugated to a detectable compound may be added to the well. Further, instead of coating the well with the antigen, antibody or the albumin fusion protein may be coated to the well. In this case, the detectable molecule could be the antigen conjugated to a detectable compound such as an enzymatic substrate (e.g., horseradish peroxidase or alkaline phosphatase). One of skill in the art would be knowledgeable as to the parameters that can be modified to increase the signal detected as well as other variations of ELISAs known in the art. For further discussion regarding ELISAs see, e.g., Ausubel et al, eds, 1994, Current Protocols in Molecular Biology, Vol. 1, John Wiley & Sons, Inc., New York at 11.2.1.

The binding affinity of an albumin fusion protein to a protein, antigen, or epitope and the off-rate of an antibody- or albumin fusion protein-protein/antigen/epitope interaction can be determined by competitive binding assays. One example of a competitive binding assay is a radioimmunoassay comprising the incubation of labeled antigen (e.g., $^{3}$H or $^{125}$I) with the antibody or albumin fusion protein of the invention in the presence of increasing amounts of unlabeled antigen, and the detection of the antibody bound to the labeled antigen. The affinity of the antibody or albumin fusion protein of the invention for a specific protein, antigen, or epitope and the binding off-rates can be determined from the data by Scatchard plot analysis. Competition with a second protein that binds the same protein, antigen or epitope as the antibody or albumin fusion protein, can also be determined using radioimmunoassays. In this case, the protein, antigen or epitope is incubated with an antibody or albumin fusion protein of the invention conjugated to a labeled compound (e.g., $^{3}$H or $^{125}$I) in the presence of increasing amounts of an unlabeled second protein that binds the same protein, antigen, or epitope as the albumin fusion protein of the invention.

In a preferred embodiment, BIAcore kinetic analysis is used to determine the binding on and off rates of antibody or albumin fusion proteins of the invention to a protein, antigen or epitope. BIAcore kinetic analysis comprises analyzing the binding and dissociation of antibodies, albumin fusion proteins, or specific polypeptides, antigens or epitopes from chips with immobilized specific polypeptides, antigens or epitopes, antibodies or albumin fusion proteins, respectively, on their surface.

Therapeutic Uses

The present invention is further directed to antibody-based therapies which involve administering antibodies of the invention or albumin fusion proteins of the invention comprising at least a fragment or variant of an antibody that binds a Therapeutic protein to an animal, preferably a mammal, and most preferably a human, patient for treating one or more of the disclosed diseases, disorders, or conditions. Therapeutic compounds of the invention include, but are not limited to, antibodies of the invention (including fragments, analogs and derivatives thereof as described herein), nucleic acids encoding antibodies of the invention (including fragments, analogs and derivatives thereof and anti-idiotypic antibodies as described herein), albumin fusion proteins of the invention comprising at least a fragment or variant of an antibody that binds a Therapeutic protein, and nucleic acids encoding such albumin fusion proteins. The antibodies of the invention or albumin fusion proteins of the invention comprising at least a fragment or variant of an antibody that binds a Therapeutic protein can be used to treat, inhibit or prevent diseases, disorders or conditions associated with aberrant expression and/or activity of a Therapeutic protein, including, but not limited to, any one or more of the diseases, disorders, or conditions described herein. The treatment and/or prevention of diseases, disorders, or conditions associated with aberrant expression and/or activity of a Therapeutic protein includes, but is not limited to, alleviating symptoms associated with those diseases, disorders or conditions, antibodies of the invention or albumin fusion proteins of the invention comprising at least a fragment or variant of an antibody that binds a Therapeutic protein may be provided in pharmaceutically acceptable compositions as known in the art or as described herein.

In a specific and preferred embodiment, the present invention is directed to antibody-based therapies which involve administering antibodies of the invention or albumin fusion proteins of the invention comprising at least a fragment or variant of an antibody that binds a Therapeutic protein to an animal, preferably a mammal, and most preferably a human, patient for treating one or more diseases, disorders, or conditions, including but not limited to: neural disorders, immune system disorders, muscular disorders, reproductive disorders, gastrointestinal disorders, pulmonary disorders, cardiovascular disorders, renal disorders, proliferative disorders, and/or cancerous diseases and conditions., and/or as described elsewhere herein. Therapeutic compounds of the invention include, but are not limited to, antibodies of the invention (e.g., antibodies directed to the full length protein expressed on the cell surface of a mammalian cell; antibodies directed to an epitope of a Therapeutic protein and nucleic acids encoding antibodies of the invention (including fragments, analogs and derivatives thereof and anti-idiotypic antibodies as described herein). The antibodies of the invention can be used to treat, inhibit or prevent diseases, disorders or conditions associated with aberrant expression and/or activity of a Therapeutic protein, including, but not limited to, any one or more of the diseases, disorders, or conditions described herein. The treatment and/or prevention of diseases, disorders, or conditions associated with aberrant expression and/or activity of a Therapeutic protein includes, but is not limited to, alleviating symptoms associated with those diseases, disorders or conditions. Antibodies of the invention or albumin fusion proteins of the invention comprising at least a fragment or variant of an antibody that binds a Therapeutic protein may be provided in pharmaceutically acceptable compositions as known in the art or as described herein.

A summary of the ways in which the antibodies of the invention or albumin fusion proteins of the invention comprising at least a fragment or variant of an antibody that binds a Therapeutic protein may be used therapeutically includes binding Therapeutic proteins locally or systemically in the body or by direct cytotoxicity of the antibody, e.g. as mediated by complement (CDC) or by effector cells (ADCC). Some of these approaches are described in more detail below. Armed with the teachings provided herein, one of ordinary skill in the art will know how to use the antibodies of the invention or albumin fusion proteins of the invention comprising at least a fragment or variant of an antibody that binds a Therapeutic protein for diagnostic, monitoring or therapeutic purposes without undue experimentation.

The antibodies of the invention or albumin fusion proteins of the invention comprising at least a fragment or variant of an antibody that binds a Therapeutic protein may be advantageously utilized in combination with other monoclonal or chimeric antibodies, or with lymphokines or hematopoietic growth factors (such as, e.g., IL-2, IL-3 and IL-7), for example, which serve to increase the number or activity of effector cells which interact with the antibodies.

The antibodies of the invention or albumin fusion proteins of the invention comprising at least a fragment or variant of an antibody that binds a Therapeutic protein may be administered alone or in combination with other types of treatments (e.g., radiation therapy, chemotherapy, hormonal therapy, immunotherapy and anti-tumor agents). Generally, administration of products of a species origin or species reactivity (in the case of antibodies) that is the same species as that of the patient is preferred. Thus, in a preferred embodiment, human antibodies, fragments derivatives, analogs, or nucleic acids, are administered to a human patient for therapy or prophylaxis.

It is preferred to use high affinity and/or potent in vivo inhibiting and/or neutralizing antibodies against Therapeutic proteins, fragments or regions thereof, (or the albumin fusion protein correlate of such an antibody) for both immunoassays directed to and therapy of disorders related to polynucleotides or polypeptides, including fragments thereof, of the present invention. Such antibodies, fragments, or regions, will preferably have an affinity for polynucleotides or polypeptides of the invention, including fragments thereof. Preferred binding affinities include dissociation constants or Kd's less than $5\times10^{-2}$ M, $10^{-2}$ M, $5\times10^{-3}$ M, $10^{-3}$ M, $5\times10^{-4}$ M, $10^{-4}$ M. More preferred binding affinities include those with a dissociation constant or Kd less than $5\times10^{-5}$ M, $10^{-5}$ M, $5\times10^{-6}$ M, $10^{-6}$M, $5\times10^{-7}$ M, $10^{7}$ M, $5\times10^{-8}$ M or $10^{-8}$ M. Even more preferred binding affinities include those with a dissociation constant or Kd less than $5\times10^{-9}$ M, $10^{-9}$ M, $5\times10^{-10}$ M, $10^{-10}$ M, $5\times10^{-11}$ M, $10^{-11}$ M, $5\times10^{-12}$ M, $10^{-12}$ M, $5\times10^{-13}$ M, $10^{-13}$ M, $5\times10^{-14}$ M, $10^{-14}$ M, $5\times10^{-15}$ M, or $10^{-15}$ M.

Gene Therapy

In a specific embodiment, nucleic acids comprising sequences encoding antibodies that bind therapeutic proteins or albumin fusion proteins comprising at least a fragment or variant of an antibody that binds a Therapeutic protein are administered to treat, inhibit or prevent a disease or disorder associated with aberrant expression and/or activity of a Therapeutic protein, by way of gene therapy. Gene therapy refers to therapy performed by the administration to a subject of an expressed or expressible nucleic acid. In this embodiment of the invention, the nucleic acids produce their encoded protein that mediates a therapeutic effect.

Any of the methods for gene therapy available in the art can be used according to the present invention. Exemplary methods are described in more detail elsewhere in this application.

Demonstration of Therapeutic or Prophylactic Activity

The compounds or pharmaceutical compositions of the invention are preferably tested in vitro, and then in vivo for the desired therapeutic or prophylactic activity, prior to use in humans. For example, in vitro assays to demonstrate the therapeutic or prophylactic utility of a compound or pharmaceutical composition include, the effect of a compound on a cell line or a patient tissue sample. The effect of the compound or composition on the cell line and/or tissue sample can be determined utilizing techniques known to those of skill in the art including, but not limited to, rosette formation assays and cell lysis assays. In accordance with the invention, in vitro assays which can be used to determine whether administration of a specific compound is indicated, include in vitro cell culture assays in which a patient tissue sample is grown in culture, and exposed to or otherwise administered a compound, and the effect of such compound upon the tissue sample is observed.

Therapeutic/Prophylactic Administration and Composition

The invention provides methods of treatment, inhibition and prophylaxis by administration to a subject of an effective amount of a compound or pharmaceutical composition of the invention. In a preferred embodiment, the compound is substantially purified (e.g., substantially free from substances that limit its effect or produce undesired side-effects). The subject is preferably an animal, including but not limited to animals such as cows, pigs, horses, chickens, cats, dogs, etc., and is preferably a mammal, and most preferably human.

Formulations and methods of administration that can be employed when the compound comprises a nucleic acid or an immunoglobulin are described above; additional appropriate formulations and routes of administration can be selected from among those described herein below.

Various delivery systems are known and can be used to administer a compound of the invention, e.g., encapsulation in liposomes, microparticles, microcapsules, recombinant cells capable of expressing the compound, receptor-mediated endocytosis (see, e.g., Wu and Wu, J. Biol. Chem. 262:4429-4432 (1987)), construction of a nucleic acid as part of a retroviral or other vector, etc. Methods of introduction include but are not limited to intradermal, intramuscular, intraperitoneal, intravenous, subcutaneous, intranasal, epidural, and oral routes. The compounds or compositions may be administered by any convenient route, for example by infusion or bolus injection, by absorption through epithelial or mucocutaneous linings (e.g., oral mucosa, rectal and intestinal mucosa, etc.) and may be administered together with other biologically active agents. Administration can be systemic or local. In addition, it may be desirable to introduce the pharmaceutical compounds or compositions of the invention into the central nervous system by any suitable route, including intraventricular and intrathecal injection; intraventricular injection may be facilitated by an intraventricular catheter, for example, attached to a reservoir, such as an Ommaya reservoir. Pulmonary administration can also be employed, e.g., by use of an inhaler or nebulizer, and formulation with an aerosolizing agent.

In a specific embodiment, it may be desirable to administer the pharmaceutical compounds or compositions of the invention locally to the area in need of treatment; this may be achieved by, for example, and not by way of limitation, local infusion during surgery, topical application, e.g., in conjunction with a wound dressing after surgery, by injection, by means of a catheter, by means of a suppository, or by means of an implant, said implant being of a porous, non-porous, or gelatinous material, including membranes, such as sialastic membranes, or fibers. Preferably, when administering a protein, including an antibody, of the invention, care must be taken to use materials to which the protein does not absorb.

In another embodiment, the compound or composition can be delivered in a vesicle, in particular a liposome (see Langer, Science 249:1527-1533 (1990); Treat et al., in Liposomes in the Therapy of Infectious Disease and Cancer, Lopez-Berestein and Fidler (eds.), Liss, New York, pp. 353-365 (1989); Lopez-Berestein, ibid., pp. 317-327; see generally ibid.)

In yet another embodiment, the compound or composition can be delivered in a controlled release system. In one embodiment, a pump may be used (see Langer, supra; Sefton, CRC Crit. Ref. Biomed. Eng. 14:201 (1987); Buchwald et al., Surgery 88:507 (1980); Saudek et al., N. Engl. J. Med. 321: 574 (1989)). In another embodiment, polymeric materials can be used (see Medical Applications of Controlled Release, Langer and Wise (eds.), CRC Pres., Boca Raton, Fla. (1974); Controlled Drug Bioavailability, Drug Product Design and Performance, Smolen and Ball (eds.), Wiley, New York (1984); Ranger and Peppas, J., Macromol. Sci. Rev. Macromol. Chem. 23:61 (1983); see also Levy et al., Science 228: 190 (1985); During et al., Ann. Neurol. 25:351 (1989); Howard et al., J. Neurosurg. 71:105 (1989)). In yet another embodiment, a controlled release system can be placed in proximity of the therapeutic target, e.g., the brain, thus requiring only a fraction of the systemic dose (see, e.g., Goodson, in Medical Applications of Controlled Release, supra, vol. 2, pp. 115-138 (1984)).

Other controlled release systems are discussed in the review by Langer (Science 249:1527-1533 (1990)).

In a specific embodiment where the compound of the invention is a nucleic acid encoding a protein, the nucleic acid can be administered in vivo to promote expression of its encoded protein, by constructing it as part of an appropriate nucleic acid expression vector and administering it so that it becomes intracellular, e.g., by use of a retroviral vector (see U.S. Pat. No. 4,980,286), or by direct injection, or by use of microparticle bombardment (e.g., a gene gun; Biolistic, Dupont), or coating with lipids or cell-surface receptors or transfecting agents, or by administering it in linkage to a homeobox-like peptide which is known to enter the nucleus (see e.g., Joliot et al., Proc. Natl. Acad. Sci. USA 88:1864-1868 (1991)), etc. Alternatively, a nucleic acid can be introduced intracellularly and incorporated within host cell DNA for expression, by homologous recombination.

The present invention also provides pharmaceutical compositions. Such compositions comprise a therapeutically effective amount of a compound, and a pharmaceutically acceptable carrier. In a specific embodiment, the term "pharmaceutically acceptable" means approved by a regulatory agency of the Federal or a state government or listed in the U.S. Pharmacopeia or other generally recognized pharmacopeia for use in animals, and more particularly in humans. The term "carrier" refers to a diluent, adjuvant, excipient, or vehicle with which the therapeutic is administered. Such pharmaceutical carriers can be sterile liquids, such as water and oils, including those of petroleum, animal, vegetable or synthetic origin, such as peanut oil, soybean oil, mineral oil, sesame oil and the like. Water is a preferred carrier when the pharmaceutical composition is administered intravenously. Saline solutions and aqueous dextrose and glycerol solutions can also be employed as liquid carriers, particularly for injectable solutions. Suitable pharmaceutical excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. The composition, if desired, can also contain minor amounts of wetting or emulsifying agents, or pH buffering agents. These compositions can take the form of solutions, suspensions, emulsion, tablets, pills, capsules, powders, sustained-release formulations and the like. The composition can be formulated as a suppository, with traditional binders and carriers such as triglycerides. Oral formulation can include standard carriers such as pharmaceutical grades of mannitol, lactose, starch, magnesium stearate, sodium saccharine, cellulose, magnesium carbonate, etc. Examples of suitable pharmaceutical carriers are described in "Remington's Pharmaceutical Sciences" by E. W. Martin. Such compositions will contain a therapeutically effective amount of the compound, preferably in purified form, together with a suitable amount of carrier so as to provide the form for proper administration to the patient. The formulation should suit the mode of administration.

In a preferred embodiment, the composition is formulated in accordance with routine procedures as a pharmaceutical composition adapted for intravenous administration to human beings. Typically, compositions for intravenous administration are solutions in sterile isotonic aqueous buffer. Where necessary, the composition may also include a solubilizing agent and a local anesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the composition is to be administered by infusion, it can be dispensed with an infusion bottle containing sterile pharmaceutical grade water or saline. Where the composition is administered by injection, an ampoule of sterile water for injection or saline can be provided so that the ingredients may be mixed prior to administration.

The compounds of the invention can be formulated as neutral or salt forms. Pharmaceutically acceptable salts include those formed with anions such as those derived from hydrochloric, phosphoric, acetic, oxalic, tartaric acids, etc., and those formed with cations such as those derived from sodium, potassium, ammonium, calcium, ferric hydroxides, isopropylamine, triethylamine, 2-ethylamino ethanol, histidine, procaine, etc.

The amount of the compound of the invention which will be effective in the treatment, inhibition and prevention of a disease or disorder associated with aberrant expression and/or activity of a Therapeutic protein can be determined by standard clinical techniques. In addition, in vitro assays may optionally be employed to help identify optimal dosage ranges. The precise dose to be employed in the formulation will also depend on the route of administration, and the seriousness of the disease or disorder, and should be decided according to the judgment of the practitioner and each patient's circumstances. Effective doses may be extrapolated from dose-response curves derived from in vitro or animal model test systems.

For antibodies, the dosage administered to a patient is typically 0.1 mg/kg to 100 mg/kg of the patient's body weight. Preferably, the dosage administered to a patient is between 0.1 mg/kg and 20 mg/kg of the patient's body weight, more preferably 1 mg/kg to 10 mg/kg of the patient's body weight. Generally, human antibodies have a longer half-life within the human body than antibodies from other species due to the immune response to the foreign polypeptides. Thus, lower dosages of human antibodies and less frequent administration is often possible. Further, the dosage and frequency of administration of antibodies of the invention may be reduced by enhancing uptake and tissue penetration (e.g., into the brain) of the antibodies by modifications such as, for example, lipidation.

Diagnosis and Imaging

Labeled antibodies and derivatives and analogs thereof that bind a Therapeutic protein (or fragment or variant thereof) (including albumin fusion proteins comprising at least a fragment or variant of an antibody that binds a Therapeutic protein), can be used for diagnostic purposes to detect, diagnose, or monitor diseases, disorders, and/or conditions associated with the aberrant expression and/or activity of Therapeutic protein. The invention provides for the detection of aberrant expression of a Therapeutic protein, comprising (a) assaying the expression of the Therapeutic protein in cells or body fluid of an individual using one or more antibodies specific to the polypeptide interest and (b) comparing the level of gene expression with a standard gene expression level, whereby an increase or decrease in the assayed Therapeutic protein expression level compared to the standard expression level is indicative of aberrant expression.

The invention provides a diagnostic assay for diagnosing a disorder, comprising (a) assaying the expression of the Therapeutic protein in cells or body fluid of an individual using one or more antibodies specific to the Therapeutic protein or albumin fusion proteins comprising at least a fragment of variant of an antibody specific to a Therapeutic protein, and (b) comparing the level of gene expression with a standard gene expression level, whereby an increase or decrease in the assayed Therapeutic protein gene expression level compared to the standard expression level is indicative of a particular disorder. With respect to cancer, the presence of a relatively high amount of transcript in biopsied tissue from an individual may indicate a predisposition for the development of the disease, or may provide a means for detecting the disease prior to the appearance of actual clinical symptoms. A more definitive diagnosis of this type may allow health professionals to employ preventative measures or aggressive treatment earlier thereby preventing the development or further progression of the cancer.

Antibodies of the invention or albumin fusion proteins comprising at least a fragment of variant of an antibody specific to a Therapeutic protein can be used to assay protein levels in a biological sample using classical immunohistological methods known to those of skill in the art (e.g., see Jalkanen et al., J. Cell. Biol. 101:976-985 (1985); Jalkanen et al., J. Cell. Biol. 105:3087-3096 (1987)). Other antibody-based methods useful for detecting protein gene expression include immunoassays, such as the enzyme linked immunosorbent assay (ELISA) and the radioimmunoassay (RIA). Suitable antibody assay labels are known in the art and include enzyme labels, such as, glucose oxidase; radioisotopes, such as iodine (125I, 121I), carbon (14C), sulfur (35S), tritium (3H), indium (112In), and technetium (99Tc); luminescent labels, such as luminol; and fluorescent labels, such as fluorescein and rhodamine, and biotin.

One facet of the invention is the detection and diagnosis of a disease or disorder associated with aberrant expression of a Therapeutic protein in an animal, preferably a mammal and most preferably a human. In one embodiment, diagnosis comprises: a) administering (for example, parenterally, subcutaneously, or intraperitoneally) to a subject an effective amount of a labeled molecule which specifically binds to the polypeptide of interest; b) waiting for a time interval following the administering for permitting the labeled molecule to preferentially concentrate at sites in the subject where the Therapeutic protein is expressed (and for unbound labeled molecule to be cleared to background level); c) determining background level; and d) detecting the labeled molecule in the subject, such that detection of labeled molecule above the background level indicates that the subject has a particular disease or disorder associated with aberrant expression of the therapeutic protein. Background level can be determined by various methods including, comparing the amount of labeled molecule detected to a standard value previously determined for a particular system.

It will be understood in the art that the size of the subject and the imaging system used will determine the quantity of imaging moiety needed to produce diagnostic images. In the case of a radioisotope moiety, for a human subject, the quantity of radioactivity injected will normally range from about 5 to 20 millicuries of 99mTc. The labeled antibody, antibody fragment, or albumin fusion protein comprising at least a fragment or variant of an antibody that binds a Therapeutic protein will then preferentially accumulate at the location of cells which contain the specific Therapeutic protein. In vivo tumor imaging is described in S. W. Burchiel et al., "Immunopharmacokinetics of Radiolabeled Antibodies and Their Fragments." (Chapter 13 in Tumor Imaging: The Radiochemical Detection of Cancer, S. W. Burchiel and B. A. Rhodes, eds., Masson Publishing Inc. (1982)).

Depending on several variables, including the type of label used and the mode of administration, the time interval following the administration for permitting the labeled molecule to preferentially concentrate at sites in the subject and for unbound labeled molecule to be cleared to background level is 6 to 48 hours or 6 to 24 hours or 6 to 12 hours. In another embodiment the time interval following administration is 5 to 20 days or 5 to 10 days.

In an embodiment, monitoring of the disease or disorder is carried out by repeating the method for diagnosing the disease or disease, for example, one month after initial diagnosis, six months after initial diagnosis, one year after initial diagnosis, etc.

Presence of the labeled molecule can be detected in the patient using methods known in the art for in vivo scanning. These methods depend upon the type of label used. Skilled artisans will be able to determine the appropriate method for detecting a particular label. Methods and devices that may be used in the diagnostic methods of the invention include, but are not limited to, computed tomography (CT), whole body scan such as position emission tomography (PET), magnetic resonance imaging (MRI), and sonography.

In a specific embodiment, the molecule is labeled with a radioisotope and is detected in the patient using a radiation responsive surgical instrument (Thurston et al., U.S. Pat. No. 5,441,050). In another embodiment, the molecule is labeled with a fluorescent compound and is detected in the patient using a fluorescence responsive scanning instrument. In another embodiment, the molecule is labeled with a positron emitting metal and is detected in the patent using positron emission-tomography. In yet another embodiment, the molecule is labeled with a paramagnetic label and is detected in a patient using magnetic resonance imaging (MRI). Antibodies that specifically detect the albumin fusion protein but not albumin or the therapeutic protein alone are a preferred embodiment. These can be used to detect the albumin fusion protein as described throughout the specification.

Kits

The present invention provides kits that can be used in the above methods. In one embodiment, a kit comprises an antibody, preferably a purified antibody, in one or more containers. In a specific embodiment, the kits of the present invention contain a substantially isolated polypeptide comprising an epitope which is specifically immunoreactive with an antibody included in the kit. Preferably, the kits of the present invention further comprise a control antibody which does not react with the polypeptide of interest. In another specific embodiment, the kits of the present invention contain a means for detecting the binding of an antibody to a polypeptide of interest (e.g., the antibody may be conjugated to a detectable substrate such as a fluorescent compound, an enzymatic substrate, a radioactive compound or a luminescent compound, or a second antibody which recognizes the first antibody may be conjugated to a detectable substrate).

In another specific embodiment of the present invention, the kit is a diagnostic kit for use in screening serum containing antibodies specific against proliferative and/or cancerous polynucleotides and polypeptides. Such a kit may include a control antibody that does not react with the polypeptide of interest. Such a kit may include a substantially isolated polypeptide antigen comprising an epitope which is specifically immunoreactive with at least one anti-polypeptide antigen antibody. Further, such a kit includes means for detecting the binding of said antibody to the antigen (e.g., the antibody may be conjugated to a fluorescent compound such as fluorescein or rhodamine which can be detected by flow cytometry). In specific embodiments, the kit may include a recombinantly produced or chemically synthesized polypeptide antigen. The polypeptide antigen of the kit may also be attached to a solid support.

In a more specific embodiment the detecting means of the above-described kit includes a solid support to which said polypeptide antigen is attached. Such a kit may also include a non-attached reporter-labeled anti-human antibody. In this embodiment, binding of the antibody to the polypeptide antigen can be detected by binding of the said reporter-labeled antibody.

In an additional embodiment, the invention includes a diagnostic kit for use in screening serum containing antigens of the polypeptide of the invention. The diagnostic kit includes a substantially isolated antibody specifically immunoreactive with polypeptide or polynucleotide antigens, and means for detecting the binding of the polynucleotide or polypeptide antigen to the antibody. In one embodiment, the antibody is attached to a solid support. In a specific embodiment, the antibody may be a monoclonal antibody. The detecting means of the kit may include a second, labeled monoclonal antibody. Alternatively, or in addition, the detecting means may include a labeled, competing antigen.

In one diagnostic configuration, test serum is reacted with a solid phase reagent having a surface-bound antigen obtained by the methods of the present invention. After binding with specific antigen antibody to the reagent and removing unbound serum components by washing, the reagent is reacted with reporter-labeled anti-human antibody to bind reporter to the reagent in proportion to the amount of bound anti-antigen antibody on the solid support. The reagent is again washed to remove unbound labeled antibody, and the amount of reporter associated with the reagent is determined. Typically, the reporter is an enzyme which is detected by incubating the solid phase in the presence of a suitable fluorometric, luminescent or calorimetric substrate (Sigma, St. Louis, Mo.).

The solid surface reagent in the above assay is prepared by known techniques for attaching protein material to solid support material, such as polymeric beads, dip sticks, 96-well plate or filter material. These attachment methods generally include non-specific adsorption of the protein to the support or covalent attachment of the protein, typically through a free amine group, to a chemically reactive group on the solid support, such as an activated carboxyl, hydroxyl, or aldehyde group. Alternatively, streptavidin coated plates can be used in conjunction with biotinylated antigen(s).

Thus, the invention provides an assay system or kit for carrying out this diagnostic method. The kit generally includes a support with surface-bound recombinant antigens, and a reporter-labeled anti-human antibody for detecting surface-bound anti-antigen antibody.

Albumin Fusion Proteins

The present invention relates generally to albumin fusion proteins and methods of treating, preventing, or ameliorating diseases or disorders. As used herein, "albumin fusion protein" refers to a protein formed by the fusion of at least one molecule of albumin (or a fragment or variant thereof) to at least one molecule of a Therapeutic protein (or fragment or variant thereof). An albumin fusion protein of the invention comprises at least a fragment or variant of a Therapeutic protein and at least a fragment or variant of human serum albumin, which are associated with one another, preferably by genetic fusion (i.e., the albumin fusion protein is generated by translation of a nucleic acid in which a polynucleotide encoding all or a portion of a Therapeutic protein is joined in-frame with a polynucleotide encoding all or a portion of albumin) or to one another. The Therapeutic protein and albumin protein, once part of the albumin fusion protein, may each be referred to as a "portion", "region" or "moiety" of the albumin fusion protein.

In a preferred embodiment, the invention provides an albumin fusion protein encoded by a polynucleotide or albumin fusion construct described in Table 1 or Table 2. Polynucleotides encoding these albumin fusion proteins are also encompassed by the invention.

Preferred albumin fusion proteins of the invention, include, but are not limited to, albumin fusion proteins encoded by a nucleic acid molecule comprising, or alternatively consisting of, a polynucleotide encoding at least one molecule of albumin (or a fragment or variant thereof) joined in frame to at least one polynucleotide encoding at least one molecule of a Therapeutic protein (or fragment or variant thereof); a nucleic acid molecule comprising, or alternatively consisting of, a polynucleotide encoding at least one molecule of albumin (or a fragment or variant thereof) joined in frame to at least one polynucleotide encoding at least one molecule of a Therapeutic protein (or fragment or variant thereof) generated as described in Table 1, Table 2 or in the Examples; or a nucleic acid molecule comprising, or alternatively consisting of, a polynucleotide encoding at least one molecule of albumin (or a fragment or variant thereof) joined in frame to at least one polynucleotide encoding at least one molecule of a Therapeutic protein (or fragment or variant thereof), further comprising, for example, one or more of the following elements: (1) a functional self-replicating vector (including but not limited to, a shuttle vector, an expression vector, an integration vector, and/or a replication system), (2) a region for initiation of transcription (e.g., a promoter region, such as for example, a regulatable or inducible promoter, a constitutive promoter), (3) a region for termination of transcription, (4) a leader sequence, and (5) a selectable marker.

In one embodiment, the invention provides an albumin fusion protein comprising, or alternatively consisting of, a Therapeutic protein (e.g., as described in Table 1) and a serum albumin protein. In other embodiments, the invention provides an albumin fusion protein comprising, or alternatively consisting of, a biologically active and/or therapeutically active fragment of a Therapeutic protein and a serum albumin protein. In other embodiments, the invention provides an albumin fusion protein comprising, or alternatively consisting of, a biologically active and/or therapeutically active variant of a Therapeutic protein and a serum albumin protein. In preferred embodiments, the serum albumin protein component of the albumin fusion protein is the mature portion of serum albumin.

In further embodiments, the invention provides an albumin fusion protein comprising, or alternatively consisting of, a Therapeutic protein, and a biologically active and/or therapeutically active fragment of serum albumin. In further embodiments, the invention provides an albumin fusion protein comprising, or alternatively consisting of, a Therapeutic protein and a biologically active and/or therapeutically active variant of serum albumin. In preferred embodiments, the Therapeutic protein portion of the albumin fusion protein is the mature portion of the Therapeutic protein.

In further embodiments, the invention provides an albumin fusion protein comprising, or alternatively consisting of, a biologically active and/or therapeutically active fragment or variant of a Therapeutic protein and a biologically active and/or therapeutically active fragment or variant of serum albumin. In preferred embodiments, the invention provides an albumin fusion protein comprising, or alternatively consisting of, the mature portion of a Therapeutic protein and the mature portion of serum albumin.

Preferably, the albumin fusion protein comprises HA as the N-terminal portion, and a Therapeutic protein as the C-terminal portion. Alternatively, an albumin fusion protein comprising HA as the C-terminal portion, and a Therapeutic protein as the N-terminal portion may also be used.

In other embodiments, the albumin fusion protein has a Therapeutic protein fused to both the N-terminus and the C-terminus of albumin. In a preferred embodiment, the Therapeutic proteins fused at the N- and C-termini are the same Therapeutic proteins. In an alternative preferred embodiment, the Therapeutic proteins fused at the N- and C-termini are different Therapeutic proteins. In another preferred embodiment, the Therapeutic proteins fused at the N- and C-termini are different Therapeutic proteins which may be used to treat or prevent the same or a related disease, disorder, or condition (e.g. as listed in the "Preferred Indication Y" column of Table 1). In another preferred embodiment, the Therapeutic proteins fused at the N- and C-termini are different Therapeutic proteins which may be used to treat, ameliorate, or prevent diseases or disorders (e.g. as listed in the "Preferred Indication Y" column of Table 1) which are known in the art to commonly occur in patients simultaneously, concurrently, or consecutively, or which commonly occur in patients in association with one another.

Albumin fusion proteins of the invention encompass proteins containing one, two, three, four, or more molecules of a given Therapeutic protein X or variant thereof fused to the N- or C-terminus of an albumin fusion protein of the invention, and/or to the N- and/or C-terminus of albumin or variant thereof. Molecules of a given Therapeutic protein X or variants thereof may be in any number of orientations, including, but not limited to, a 'head to head' orientation (e.g., wherein the N-terminus of one molecule of a Therapeutic protein X is fused to the N-terminus of another molecule of the Therapeutic protein X), or a 'head to tail' orientation (e.g., wherein the C-terminus of one molecule of a Therapeutic protein X is fused to the N-terminus of another molecule of Therapeutic protein X).

In one embodiment, one, two, three, or more tandemly oriented Therapeutic protein X polypeptides (or fragments or variants thereof) are fused to the N- or C-terminus of an albumin fusion protein of the invention, and/or to the N- and/or C-terminus of albumin or variant thereof.

Albumin fusion proteins of the invention further encompass proteins containing one, two, three, four, or more molecules of a given Therapeutic protein X or variant thereof fused to the N- or C-terminus of an albumin fusion protein of the invention, and/or to the N- and/or C-terminus of albumin or variant thereof, wherein the molecules are joined through peptide linkers. Examples include those peptide linkers described in U.S. Pat. No. 5,073,627 (hereby incorporated by reference). Albumin fusion proteins comprising multiple Therapeutic protein X polypeptides separated by peptide linkers may be produced using conventional recombinant DNA technology. Linkers are particularly important when fusing a small peptide to the large HSA molecule. The peptide itself can be a linker by fusing tandem copies of the peptide or other known linkers can be used. Constructs that incorporate linkers are described in Table 2 or are apparent when examining SEQ ID NO:Y.

Further, albumin fusion proteins of the invention may also be produced by fusing a Therapeutic protein X or variants thereof to the N-terminal and/or C-terminal of albumin or variants thereof in such a way as to allow the formation of intramolecular and/or intermolecular multimeric forms. In one embodiment of the invention, albumin fusion proteins may be in monomeric or multimeric forms (i.e., dimers, trimers, tetramers and higher multimers). In a further embodiment of the invention, the Therapeutic protein portion of an albumin fusion protein may be in monomeric form or multimeric form (i.e., dimers, trimers, tetramers and higher multimers). In a specific embodiment, the Therapeutic protein portion of an albumin fusion protein is in multimeric form (i.e., dimers, trimers, tetramers and higher multimers), and the albumin protein portion is in monomeric form.

In addition to albumin fusion protein in which the albumin portion is fused N-terminal and/or C-terminal of the Therapeutic protein portion, albumin fusion proteins of the invention may also be produced by inserting the Therapeutic protein or peptide of interest (e.g., a Therapeutic protein X as disclosed in Table 1, or an antibody that binds a Therapeutic protein or a fragment or variant thereof) into an internal region of HA. For instance, within the protein sequence of the HA molecule a number of loops or turns exist between the end and beginning of α-helices, which are stabilized by disulphide bonds. The loops, as determined from the crystal structure of HA (PDB identifiers 1AO6, 1BJ5, 1BKE, 1BM0, 1E7E to 1E7I and 1UOR) for the most part extend away from the body of the molecule. These loops are useful for the insertion, or internal fusion, of therapeutically active peptides, particularly those requiring a secondary structure to be functional, or Therapeutic proteins, to essentially generate an albumin molecule with specific biological activity.

Loops in human albumin structure into which peptides or polypeptides may be inserted to generate albumin fusion proteins of the invention include: Val54-Asn61, Thr76-Asp89, Ala92-Glu100, Gln170-Ala176, His 247-Glu252, Glu 266-Glu277, Glu 280-His288, Ala362-Glu368, Lys439-Pro447, Val462-Lys475, Thr478-Pro486, and Lys560-Thr566. In more preferred embodiments, peptides or polypeptides are inserted into the Val54-Asn61, Gln170-Ala176, and/or Lys560-Thr566 loops of mature human albumin (SEQ ID NO:1).

Peptides to be inserted may be derived from either phage display or synthetic peptide libraries screened for specific biological activity or from the active portions of a molecule with the desired function. Additionally, random peptide libraries may be generated within particular loops or by insertions of randomized peptides into particular loops of the HA molecule and in which all possible combinations of amino acids are represented.

Such library(s) could be generated on HA or domain fragments of HA by one of the following methods:

randomized mutation of amino acids within one or more peptide loops of HA or HA domain fragments. Either one, more or all the residues within a loop could be mutated in this manner;

replacement of, or insertion into one or more loops of HA or HA domain fragments (i.e., internal fusion) of a randomized peptide(s) of length $X_n$ (where X is an amino acid and n is the number of residues;

N-, C- or N- and C-terminal peptide/protein fusions in addition to (a) and/or (b).

The HA or HA domain fragment may also be made multifunctional by grafting the peptides derived from different screens of different loops against different targets into the same HA or HA domain fragment.

In preferred embodiments, peptides inserted into a loop of human serum albumin are peptide fragments or peptide variants of the Therapeutic proteins disclosed in Table 1. More particularly, the invention encompasses albumin fusion proteins which comprise peptide fragments or peptide variants at least 7 at least 8, at least 9, at least 10, at least 11, at least 12, at least 13, at least 14, at least 15, at least 20, at least 25, at least 30, at least 35, or at least 40 amino acids in length inserted into a loop of human serum albumin. The invention also encompasses albumin fusion proteins which comprise peptide fragments or peptide variants at least 7 at least 8, at least 9, at least 10, at least 11, at least 12, at least 13, at least 14, at least 15, at least 20, at least 25, at least 30, at least 35, or at least 40 amino acids fused to the N-terminus of human serum albumin. The invention also encompasses albumin fusion proteins which comprise peptide fragments or peptide variants at least 7 at least 8, at least 9, at least 10, at least 11, at least 12, at least 13, at least 14, at least 15, at least 20, at least 25, at least 30, at least 35, or at least 40 amino acids fused to the C-terminus of human serum albumin. For example, short peptides described in Table 1 and 2 (e.g., Therapeutic Y) can be inserted into the albumin loops.

Generally, the albumin fusion proteins of the invention may have one HA-derived region and one Therapeutic protein-derived region. Multiple regions of each protein, however, may be used to make an albumin fusion protein of the invention. Similarly, more than one Therapeutic protein may be used to make an albumin fusion protein of the invention. For instance, a Therapeutic protein may be fused to both the N- and C-terminal ends of the HA. In such a configuration, the Therapeutic protein portions may be the same or different Therapeutic protein molecules. The structure of bifunctional albumin fusion proteins may be represented as: X-HA-Y or Y-HA-X.

For example, an anti-BLyS™ scFv-HA-IFNα-2b fusion may be prepared to modulate the immune response to IFNα-2b by anti-BLyS™ scFv. An alternative is making a bi (or even multi) functional dose of HA-fusions e.g. HA-IFNα-2b fusion mixed with HA-anti-BLyS™ scFv fusion or other HA-fusions in various ratio's depending on function, half-life etc.

Bi- or multi-functional albumin fusion proteins may also be prepared to target the Therapeutic protein portion of a fusion to a target organ or cell type via protein or peptide at the opposite terminus of HA.

As an alternative to the fusion of known therapeutic molecules, the peptides could be obtained by screening libraries constructed as fusions to the N-, C- or N- and C-termini of HA, or domain fragment of HA, of typically 6, 8, 12, 20 or 25 or $X_n$ (where X is an amino acid (aa) and n equals the number of residues) randomized amino acids, and in which all possible combinations of amino acids were represented. A particular advantage of this approach is that the peptides may be selected in situ on the HA molecule and the properties of the peptide would therefore be as selected for rather than, potentially, modified as might be the case for a peptide derived by any other method then being attached to HA.

Additionally, the albumin fusion proteins of the invention may include a linker peptide between the fused portions to provide greater physical separation between the moieties and thus maximize the accessibility of the Therapeutic protein portion, for instance, for binding to its cognate receptor. The linker peptide may consist of amino acids such that it is flexible or more rigid.

The linker sequence may be cleavable by a protease or chemically to yield the growth hormone related moiety. Preferably, the protease is one which is produced naturally by the host, for example the *S. cerevisiae* protease kex2 or equivalent proteases.

Therefore, as described above, the albumin fusion proteins of the invention may have the following formula R1-L-R2; R2-L-R1; or R1-L-R2-L-R1, wherein R1 is at least one Therapeutic protein, peptide or polypeptide sequence, and not necessarily the same Therapeutic protein, L is a linker and R2 is a serum albumin sequence.

In preferred embodiments, albumin fusion proteins of the invention comprising a Therapeutic protein have a higher plasma stability compared to the plasma stability of the same Therapeutic protein when not fused to albumin. Plasma stability typically refers to the time period between when the Therapeutic protein is administered in vivo and carried into the bloodstream and when the therapeutic protein is degraded and cleared from the bloodstream, into an organ, such as the kidney or liver, that ultimately clears the Therapeutic protein from the body. Plasma stability is calculated in terms of the half-life of the Therapeutic protein in the bloodstream. The half-life of the Therapeutic protein in the bloodstream can be readily determined by common assays known in the art.

In preferred embodiments, Albumin fusion proteins of the invention comprising a Therapeutic protein have extended shelf life compared to the shelf life the same Therapeutic protein when not fused to albumin. Shelf-life typically refers to the time period over which the therapeutic activity of a Therapeutic protein in solution or in some other storage formulation, is stable without undue loss of therapeutic activity. Many of the Therapeutic proteins are highly labile in their unfused state. As described below, the typical shelf-life of these Therapeutic proteins is markedly prolonged upon incorporation into the albumin fusion protein of the invention.

Albumin fusion proteins of the invention with "prolonged" or "extended" shelf-life exhibit greater therapeutic activity relative to a standard that has been subjected to the same storage and handling conditions. The standard may be the unfused full-length Therapeutic protein. When the Therapeutic protein portion of the albumin fusion protein is an analog, a variant, or is otherwise altered or does not include the complete sequence for that protein, the prolongation of therapeutic activity may alternatively be compared to the unfused equivalent of that analog, variant, altered peptide or incomplete sequence. As an example, an albumin fusion protein of the invention may retain greater than about 100% of the therapeutic activity, or greater than about 105%, 110%, 120%, 130%, 150% or 200% of the therapeutic activity of a standard when subjected to the same storage and handling conditions as the standard when compared at a given time point.

Shelf-life may also be assessed in terms of therapeutic activity remaining after storage, normalized to therapeutic activity when storage began. Albumin fusion proteins of the invention with prolonged or extended shelf-life as exhibited by prolonged or extended therapeutic activity may retain greater than about 50% of the therapeutic activity, about 60%, 70%, 80%, or 90% or more of the therapeutic activity of the equivalent unfused Therapeutic protein when subjected to the same conditions.

Expression of Fusion Proteins

The albumin fusion proteins of the invention may be produced as recombinant molecules by secretion from yeast, a microorganism such as a bacterium, or a human or animal cell line. Preferably, the polypeptide is secreted from the host cells.

A particular embodiment of the invention comprises a DNA construct encoding a signal sequence effective for directing secretion in yeast, particularly a yeast-derived signal sequence (especially one which is homologous to the yeast host), and the fused molecule of the first aspect of the invention, there being no yeast-derived pro sequence between the signal and the mature polypeptide.

The *Saccharomyces cerevisiae* invertase signal is a preferred example of a yeast-derived signal sequence.

Conjugates of the kind prepared by Poznansky et al., (FEBS Lett. 239:18 (1988)), in which separately-prepared polypeptides are joined by chemical cross-linking, are not contemplated.

The present invention also includes a cell, preferably a yeast cell transformed to express an albumin fusion protein of the invention. In addition to the transformed host cells themselves, the present invention also contemplates a culture of those cells, preferably a monoclonal (clonally homogeneous) culture, or a culture derived from a monoclonal culture, in a nutrient medium. If the polypeptide is secreted, the medium will contain the polypeptide, with the cells, or without the cells if they have been filtered or centrifuged away. Many expression systems are known and may be used, including bacteria (for example *E. coli* and *Bacillus subtilis*), yeasts (for example *Saccharomyces cerevisiae, Kluyveromyces lactis* and *Pichia pastoris*, filamentous fungi (for example *Aspergillus*), plant cells, animal cells and insect cells.

Preferred yeast strains to be used in the production of albumin fusion proteins are D88, DXY1 and BXP10. D88 [leu2-3, leu2-122, can1, pra1, ubc4] is a derivative of parent strain AH22his$^+$ (also known as DB1; see, e.g., Sleep et al. Biotechnology 8:42-46 (1990)). The strain contains a leu2 mutation which allows for auxotropic selection of 2 micron-based plasmids that contain the LEU2 gene. D88 also exhibits a derepression of PRB1 in glucose excess. The PRB1 promoter is normally controlled by two checkpoints that monitor glucose levels and growth stage. The promoter is activated in wild type yeast upon glucose depletion and entry into stationary phase. Strain D88 exhibits the repression by glucose but maintains the induction upon entry into stationary phase. The PRA1 gene encodes a yeast vacuolar protease, YscA endoprotease A, that is localized in the ER. The UBC4 gene is in the ubiquitination pathway and is involved in targeting short lived and abnormal proteins for ubiquitin dependant degradation. Isolation of this ubc4 mutation was found to increase the copy number of an expression plasmid in the cell and cause an increased level of expression of a desired protein expressed from the plasmid (see, e.g., International Publication No. WO99/00504, hereby incorporated in its entirety by reference herein).

DXY1, a derivative of D88, has the following genotype: [leu2-3, leu2-122, can1, pra1, ubc4, ura3::yap3]. In addition to the mutations isolated in D88, this strain also has a knockout of the YAP3 protease. This protease causes cleavage of mostly di-basic residues (RR, RK, KR, KK) but can also promote cleavage at single basic residues in proteins. Isolation of this yap3 mutation resulted in higher levels of full length HSA production (see, e.g., U.S. Pat. No. 5,965,386 and Kerry-Williams et al., Yeast 14:161-169 (1998), hereby incorporated in their entireties by reference herein).

BXP10 has the following genotype: leu2-3, leu2-122, can1, pra1, ubc4, ura3, yap3::URA3, lys2, hsp150::LYS2, pmt1::URA3. In addition to the mutations isolated in DXY1, this strain also has a knockout of the PMT1 gene and the HSP150 gene. The PMT 1 gene is a member of the evolutionarily conserved family of dolichyl-phosphate-D-mannose protein O-mannosyltransferases (Pmts). The transmembrane topology of Pmt1p suggests that it is an integral membrane protein of the endoplasmic reticulum with a role in O-linked glycosylation. This mutation serves to reduce/eliminate O-linked glycosylation of HSA fusions (see, e.g., International Publication No. WO00/44772, hereby incorporated in its entirety by reference herein). Studies revealed that the Hsp150 protein is inefficiently separated from rHA by ion exchange chromatography. The mutation in the HSP150 gene removes a potential contaminant that has proven difficult to remove by standard purification techniques. See, e.g., U.S. Pat. No. 5,783,423, hereby incorporated in its entirety by reference herein.

The desired protein is produced in conventional ways, for example from a coding sequence inserted in the host chromosome or on a free plasmid. The yeasts are transformed with a coding sequence for the desired protein in any of the usual ways, for example electroporation. Methods for transformation of yeast by electroporation are disclosed in Becker & Guarente (1990) *Methods Enzymol.* 194, 182.

Successfully transformed cells, i.e., cells that contain a DNA construct of the present invention, can be identified by well known techniques. For example, cells resulting from the introduction of an expression construct can be grown to produce the desired polypeptide. Cells can be harvested and lysed and their DNA content examined for the presence of the DNA using a method such as that described by Southern (1975) *J. Mol. Biol.* 98, 503 or Berent et al. (1985) *Biotech.* 3, 208. Alternatively, the presence of the protein in the supernatant can be detected using antibodies.

Useful yeast plasmid vectors include pRS403-406 and pRS413-416 and are generally available from Stratagene Cloning Systems, La Jolla, Calif. 92037, USA. Plasmids pRS403, pRS404, pRS405 and pRS406 are Yeast Integrating plasmids (YIps) and incorporate the yeast selectable markers HIS3, 7RP1, LEU2 and URA3. Plasmids pRS413-416 are Yeast Centromere plasmids (Ycps).

Preferred vectors for making albumin fusion proteins for expression in yeast include pPPC0005, pScCHSA, pScNHSA, and pC4:HSA which are described in detail in Example 1. FIG. 2 shows a map of the pPPC0005 plasmid that can be used as the base vector into which polynucleotides encoding Therapeutic proteins may be cloned to form HA-fusions. It contains a PRB1 *S. cerevisiae* promoter (PRB1p), a Fusion leader sequence (FL), DNA encoding HA (rHA) and an ADH1 *S. cerevisiae* terminator sequence. The sequence of the fusion leader sequence consists of the first 19 amino acids of the signal peptide of human serum albumin (SEQ ID NO:3) and the last five amino acids of the mating factor alpha 1 promoter (SLDKR, see EP-A-387 319 which is hereby incorporated by reference in its entirety).

The plasmids, pPPC0005, pScCHSA, pScNHSA, and pC4:HSA were deposited on Apr. 11, 2001 at the American Type Culture Collection, 10801 University Boulevard, Manassas, Va. 20110-2209 and given accession numbers ATCC™ PTA-3278, PTA-3276, PTA-3279, and PTA-3277, respectively. Another vector useful for expressing an albumin fusion protein in yeast the pSAC35 vector which is described in Sleep et al., BioTechnology 8:42 (1990) which is hereby incorporated by reference in its entirety.

A yeast promoter that can be used to express the albumin fusion protein is the MET25 promoter. See, for example, Dominik Mumburg, Rolf Muller and Martin Funk. Nucleic Acids Research, 1994, Vol. 22, No. 25, pp. 5767-5768. The Met25 promoter is 383 bases long (bases 382 to 1) and the genes expressed by this promoter are also known as Met15, Met17, and YLR303W. A preferred embodiment uses the sequence below, where, at the 5' end of the sequence below, the Not 1 site used in the cloning is underlined and at the 3' end, the ATG start codon is underlined:

(SEQ ID NO: 5)

```
GCGGCCGCCGGATGCAAGGGTTCGAATCCCTTAGCTCTCATTATTTTTTG
CTTTTTCTCTTGAGGTCACATGATCGCAAAATGGCAAATGGCACGTGAAG
CTGTCGATATTGGGGAACTGTGGTGGTTGGCAAATGACTAATTAAGTTAG
TCAAGGCGCCATCCTCATGAAAACTGTGTAACATAATAACCGAAGTGTCG
AAAAGGTGGCACCTTGTCCAATTGAACACGCTCGATGAAAAAAATAAGAT
ATATATAAGGTTAAGTAAAGCGTCTGTTAGAAAGGAAGTTTTTCCTTTTT
CTTGCTCTCTTGTCTTTTCATCTACTATTTCCTTCGTGTAATACAGGGTC
GTCAGATACATAGATACAATTCTATTACCCCCATCCATACAATG
```

Additional promoters that can be used to express the albumin fusion protein in yeast include the following:

a) the cbh1 promoter:

(SEQ ID NO: 101)

```
TCTAGAGTTGTGAAGTCGGTAATCCCGCTGTATAGTAATACGAGTCGCAT
CTAAATACTCCGAAGCTGCTGCGAACCCGGAGAATCGAGATGTGCTGGAA
AGCTTCTAGCGAGCGGCTAAATTAGCATGAAAGGCTATGAGAAATTCTGG
AGACGGCTTGTTGAATCATGGCGTTCCATTCTTCGACAAGCAAAGCGTTC
CGTCGCAGTAGCAGGCACTCATTCCCGAAAAAACTCGGAGATTCCTAAGT
AGCGATGGAACCGGAATAATATAATAGGCAATACATTGAGTTGCCTCGAC
GGTTGCAATGCAGGGGTACTGAGCTTGGACATAACTGTTCCGTACCCCAC
CTCTTCTCAACCTTTGGCGTTTCCCTGATTCAGCGTACCCGTACAAGTCG
TAATCACTATTAACCCAGACTGACCGGACGTGTTTTGCCCTTCATTTGGA
GAAATAATGTCATTGCGATGTGTAATTTGCCTGCTTGACCGACTGGGGCT
GTTCGAAGCCCGAATGTAGGATTGTTATCCGAACTCTGCTCGTAGAGGCA
TGTTGTGAATCTGTGTCGGGCAGGACACGCCTCGAAGGTTCACGGCAAGG
GAAACCACCGATAGCAGTGTCTAGTAGCAACCTGTAAAGCCGCAATGCAG
CATCACTGGAAAATACAAACCAATGGCTAAAAGTACATAAGTTAATGCCT
AAAGAAGTCATATACCAGCGGCTAATAATTGTACAATCAAGTGGCTAAAC
GTACCGTAATTTGCCAACGGCTTGTGGGGTTGCAGAAGCAACGGCAAAGC
CCCACTTCCCCACGTTTGTTTCTTCACTCAGTCCAATCTCAGCTGGTGAT
CCCCCAATTGGGTCGCTTGTTTGTTCCGGTGAAGTGAAAGAAGACAGAGG
TAAGAATGTCTGACTCGGAGCGTTTTGCATACAACCAAGGGCAGTGATGG
AAGACAGTGAAATGTTGACATTCAAGGAGTATTTAGCCAGGGATGCTTGA
GTGTATCGTGTAAGGAGGTTTGTCTGCCGATACGACGAATACTGTATAGT
CACTTCTGGTGAAGTGGTCCATATTGAAATGTAAGTCGGCACTGAACAGG
CAAAAGATTGAGTTGAAACTGCCTAAGATCTCGGGCCCTCGGGCCTTCGG
CCTTTGGGTGTACATGTTTGTGCTCCGGGCAAATGCAAAGTGTGGTAGGA
TCGAACACACTGCTGCCTTTACCAAGCAGCTGAGGGTATGTGATAGGCAA
ATGTTCAGGGGCCACTGCATGGTTTCGAATAGAAAGAGAAGCTTAGCCAA
GAACAATAGCCGATAAAGATAGCCTCATTAAACGGAATGAGCTAGTAGGC
```

-continued

AAAGTCAGCGAATGTGTATATATAAAGGTTCGAGGTCCGTGCCTCCCTCA

TGCTCTCCCCATCTACTCATCAACTCAGATCCTCCAGGAGACTTGTACAC

CATCTTTTGAGGCACAGAAACCCAATAGTCAACCGCGGACTGGCATC b) the cysD promoter from *Aspergillus nidulans*:

(SEQ ID NO: 102)

AGATCTGGTTCCTGAGTACATCTACCGATGCGCCTCGATCCCCCTCTTAG

CCGCATGAGATTCCTACCATTTATGTCCTATCGTTCAGGGTCCTATTTGG

ACCGCTAGAAATAGACTCTGCTCGATTTGTTTCCATTATTCACGCAATTA

CGATAGTATTTGGCTCTTTTCGTTTGGCCCAGGTCAATTCGGGTAAGACG

CGATCACGCCATTGTGGCCGCCGGCGTTGTGCTGCTGCTATTCCCCGCAT

ATAAACAACCCCTCCACCAGTTCGTTGGGCTTTGCGAATGCTGTACTCTA

TTTCAAGTTGTCAAAAGAGAGGATTCAAAAAATTATACCCCAGATATCAA

AGATATCAAAGCCATC c) a modified cbh1 promoter having the sequence:

(SEQ ID NO: 103)

TCTAGAGTTGTGAAGTCGGTAATCCCGCTGTATAGTAATACGAGTCGCAT

CTAAATACTCCGAAGCTGCTGCGAACCCGGAGAATCGAGATGTGCTGGAA

AGCTTCTAGCGAGCGGCTAAATTAGCATGAAAGGCTATGAGAAATTCTGG

AGACGGCTTGTTGAATCATGGCGTTCCATTCTTCGACAAGCAAAGCGTTC

CGTCGCAGTAGCAGGCACTCATTCCCGAAAAAACTCGGAGATTCCTAAGT

AGCGATGGAACCGGAATAATATAATAGGCAATACATTGAGTTGCCTCGAC

GGTTGCAATGCAGGGGTACTGAGCTTGGACATAACTGTTCCGTACCCCAC

CTCTTCTCAACCTTTGGCGTTTCCCTGATTCAGCGTACCCGTACAAGTCG

TAATCACTATTAACCCAGACTGACCGGACGTGTTTTGCCCTTCATTTGGA

GAAATAATGTCATTGCGATGTGTAATTTGCCTGCTTGACCGACTGGGGCT

GTTCGAAGCCCGAATGTAGGATTGTTATCCGAACTCTGCTCGTAGAGGCA

TGTTGTGAATCTGTGTCGGGCAGGACACGCCTCGAAGGTTCACGGCAAGG

GAAACCACCGATAGCAGTGTCTAGTAGCAACCTGTAAAGCCGCAATGCAG

CATCACTGGAAAATACAAACCAATGGCTAAAAGTACATAAGTTAATGCCT

AAAGAAGTCATATACCAGCGGCTAATAATTGTACAATCAAGTGGCTAAAC

GTACCGTAATTTGCCAACGGCTTGTGGGGTTGCAGAAGCAACGGCAAAGC

CCCACTTCCCCACGTTTGTTTCTTCACTCAGTCCAATCTCAGCTGGTGAT

CCCCCAATTGGGTCGCTTGTTTGTTCCGGTGAAGTGAAAGAAGACAGAGG

TAAGAATGTCTGACTCGGAGCGTTTTGCATACAACCAAGGGCAGTGATGG

AAGACAGTGAAATGTTGACATTCAAGGAGTATTTAGCCAGGGATGCTTGA

GTGTATCGTGTAAGGAGGTTTGTCTGCCGATACGACGAATACTGTATAGT

CACTTCTGGTGAAGTGGTCCATATTGAAATGTAAGTCGGCACTGAACAGG

CAAAAGATTGAGTTGAAACTGCCTAAGATCTCGGGCCCTCGGGCCTTCGG

CCTTTGGGTGTACATGTTTGTGCTCCGGGCAAATGCAAAGTGTGGTAGGA

TCGAACACACTGCTGCCTTTACCAAGCAGCTGAGGGTATGTGATAGGCAA

-continued

ATGTTCAGGGGCCACTGCATGGTTTCGAATAGAAAGAGAAGCTTAGCCTG

CAGCCTCTTATCGAGAAAGAAATTACCGTCGCTCGTGATTTGTTTGCAAA

AAGAACAAAACTGAAAAAACCCAGACACGCTCGACTTCCTGTCTTCCTAT

TGATTGCAGCTTCCAATTTCGTCACACAACAAGGTCCTAGCTTAGCCAAG

AACAATAGCCGATAAAGATAGCCTCATTAAACGGAATGAGCTAGTAGGCA

AAGTCAGCGAATGTGTATATATAAAGGTTCGAGGTCCGTGCCTCCCTCAT

GCTCTCCCCATCTACTCATCAACTCAGATCCTCCAGGAGACTTGTACACC

ATCTTTTGAGGCACAGAAACCCAATAGTCAACCGCGGACTGGCATC d) a cysD promoter from *Aspergillus nidulans* having the sequence:

(SEQ ID NO: 104)

AGATCTGGTTCCTGAGTACATCTACCGATGCGCCTCGATCCCCCTCTTAG

CCGCATGAGATTCCTACCATTTATGTCCTATCGTTCAGGGTCCTATTTGG

ACCGCTAGAAATAGACTCTGCTCGATTTGTTTCCATTATTCACGCAATTA

CGATAGTATTTGGCTCTTTTCGTTTGGCCCAGGTCAATTCGGGTAAGACG

CGATCACGCCATTGTGGCCGCCGGCGCTGCAGCCTCTTATCGAGAAAGAA

ATTACCGTCGCTCGTGATTTGTTTGCAAAAAGAACAAAACTGAAAAAACC

CAGACACGCTCGACTTCCTGTCTTCCTATTGATTGCAGCTTCCAATTTCG

TCACACAACAAGGTCCTACGCCGGCGTTGTGCTGCTGCTATTCCCCGCAT

ATAAACAACCCCTCCACCAGTTCGTTGGGCTTTGCGAATGCTGTACTCTA

TTTCAAGTTGTCAAAAGAGAGGATTCAAAAAATTATACCCCAGATATCAA

AGATATCAAAGCCATC

A variety of methods have been developed to operably link DNA to vectors via complementary cohesive termini. For instance, complementary homopolymer tracts can be added to the DNA segment to be inserted to the vector DNA. The vector and DNA segment are then joined by hydrogen bonding between the complementary homopolymeric tails to form recombinant DNA molecules.

Synthetic linkers containing one or more restriction sites provide an alternative method of joining the DNA segment to vectors. The DNA segment, generated by endonuclease restriction digestion, is treated with bacteriophage T4 DNA polymerase or *E. coli* DNA polymerase I, enzymes that remove protruding, gamma-single-stranded termini with their 3' 5'-exonucleolytic activities, and fill in recessed 3'-ends with their polymerizing activities.

The combination of these activities therefore generates blunt-ended DNA segments. The blunt-ended segments are then incubated with a large molar excess of linker molecules in the presence of an enzyme that is able to catalyze the ligation of blunt-ended DNA molecules, such as bacteriophage T4 DNA ligase. Thus, the products of the reaction are DNA segments carrying polymeric linker sequences at their ends. These DNA segments are then cleaved with the appropriate restriction enzyme and ligated to an expression vector that has been cleaved with an enzyme that produces termini compatible with those of the DNA segment.

Synthetic linkers containing a variety of restriction endonuclease sites are commercially available from a number of sources including International Biotechnologies Inc, New Haven, Conn., USA.

A desirable way to modify the DNA in accordance with the invention, if, for example, HA variants are to be prepared, is to use the polymerase chain reaction as disclosed by Saiki et al. (1988) Science 239, 487-491. In this method the DNA to be enzymatically amplified is flanked by two specific oligonucleotide primers which themselves become incorporated into the amplified DNA. The specific primers may contain restriction endonuclease recognition sites which can be used for cloning into expression vectors using methods known in the art.

Exemplary genera of yeast contemplated to be useful in the practice of the present invention as hosts for expressing the albumin fusion proteins are *Pichia* (Hansenula), *Saccharomyces, Kluyveromyces, Candida, Torulopsis, Torulaspora, Schizosaccharomyces, Citeromyces, Pachysolen, Debaromyces, Metschunikowia, Rhodosporidium, Leucosporidium, Botryoascus, Sporidiobolus, Endomycopsis*, and the like. Preferred genera are those selected from the group consisting of *Saccharomyces, Schizosaccharomyces, Kluyveromyces, Pichia* and *Torulaspora*. Examples of *Saccharomyces* spp. are *S. cerevisiae, S. italicus* and *S. rouxii*.

Examples of *Kluyveromyces* spp. are *K. fragilis, K. lactis* and *K. marxianus*. A suitable Torulaspora species is *T. delbrueckii*. Examples of *Pichia* (Hansenula) spp. are *P. angusta* (formerly *H. polymorpha*), *P. anomala* (formerly *H. anomala*) and *P. pastoris*. Methods for the transformation of *S. cerevisiae* are taught generally in EP 251 744, EP 258 067 and WO 90/01063, all of which are incorporated herein by reference.

Preferred exemplary species of *Saccharomyces* include *S. cerevisiae, S. italicus, S. diastaticus*, and *Zygosaccharomyces rouxii*. Preferred exemplary species of *Kluyveromyces* include *K. fragilis* and *K. lactis*.

Preferred exemplary species of *Hansenula* include *H. polymorpha* (now *Pichia angusta*), *H. anomala* (now *Pichia anomala*), and *Pichia capsulata*. Additional preferred exemplary species of *Pichia* include *P. pastoris*. Preferred exemplary species of *Aspergillus* include *A. niger* and *A. nidulans*. Preferred exemplary species of *Yarrowia* include *Y. lipolytica*. Many preferred yeast species are available from the ATCC™. For example, the following preferred yeast species are available from the ATCC™ and are useful in the expression of albumin fusion proteins: *Saccharomyces cerevisiae* Hansen, teleomorph strain BY4743 yap3 mutant (ATCC™ Accession No. 4022731); *Saccharomyces cerevisiae* Hansen, teleomorph strain BY4743 hsp150 mutant (ATCC™ Accession No. 4021266); *Saccharomyces cerevisiae* Hansen, teleomorph strain BY4743 pmt1 mutant (ATCC™ Accession No. 4023792); *Saccharomyces cerevisiae* Hansen, teleomorph (ATCC™ Accession Nos. 20626; 44773; 44774; and 62995); *Saccharomyces diastaticus* Andrews et Gilliland ex van der Walt, teleomorph (ATCC™ Accession No. 62987); *Kluyveromyces lactis* (Dombrowski) van der Walt, teleomorph (ATCC™ Accession No. 76492); *Pichia angusta* (Teunisson et al.) Kurtzman, teleomorph deposited as *Hansenula polymorpha* de Morais et Maia, teleomorph (ATCC™ Accession No. 26012); *Aspergillus niger* van Tieghem, anamorph (ATCC™ Accession No. 9029); *Aspergillus niger* van Tieghem, anamorph (ATCC™ Accession No. 16404); *Aspergillus nidulans* (Eidam) Winter, anamorph (ATCC™ Accession No. 48756); and *Yarrowia lipolytica* (Wickerham et al.) van der Walt et von Arx, teleomorph (ATCC™ Accession No. 201847).

Suitable promoters for *S. cerevisiae* include those associated with the PGKI gene, GALL or GAL10 genes, CYCI, PHO5, TRPI, ADHI, ADH2, the genes for glyceraldehyde-3-phosphate dehydrogenase, hexokinase, pyruvate decarboxylase, phosphofructokinase, triose phosphate isomerase, phosphoglucose isomerase, glucokinase, alpha-mating factor pheromone, [a mating factor pheromone], the PRBI promoter, the GUT2 promoter, the GPDI promoter, and hybrid promoters involving hybrids of parts of 5' regulatory regions with parts of 5' regulatory regions of other promoters or with upstream activation sites (e.g. the promoter of EP-A-258 067).

Convenient regulatable promoters for use in *Schizosaccharomyces pombe* are the thiamine-repressible promoter from the nmt gene as described by Maundrell (1990) *J. Biol. Chem.* 265, 10857-10864 and the glucose repressible jbp1 gene promoter as described by Hoffman & Winston (1990) *Genetics* 124, 807-816.

Methods of transforming *Pichia* for expression of foreign genes are taught in, for example, Cregg et al. (1993), and various Phillips patents (e.g. U.S. Pat. No. 4,857,467, incorporated herein by reference), and *Pichia* expression kits are commercially available from Invitrogen BV, Leek, Netherlands, and Invitrogen Corp., San Diego, Calif. Suitable promoters include AOX1 and AOX2. Gleeson et al. (1986) J. Gen. Microbiol. 132, 3459-3465 include information on *Hansenula* vectors and transformation, suitable promoters being MOX1 and FMD1; whilst EP 361 991, Fleer et al. (1991) and other-publications from Rhone-Poulenc Rorer teach how to express foreign proteins in *Kluyveromyces* spp., a suitable promoter being PGKI.

The transcription termination signal is preferably the 3' flanking sequence of a eukaryotic gene which contains proper signals for transcription termination and polyadenylation. Suitable 3' flanking sequences may, for example, be those of the gene naturally linked to the expression control sequence used, i.e. may correspond to the promoter. Alternatively, they may be different in which case the termination signal of the *S. cerevisiae* ADHI gene is preferred.

The desired albumin fusion protein may be initially expressed with a secretion leader sequence, which may be any leader effective in the yeast chosen. Leaders useful in yeast include any of the following:

a) the MPIF-1 signal sequence (e.g., amino acids 1-21 of GenBank Accession number AAB51134) MKVSVAALSCLMLVTALGSQA (SEQ ID NO:6)
b) the stanniocalcin signal sequence (MLQNSAVLLLLVISASA, SEQ ID NO:7)
c) the pre-pro region of the HSA signal sequence (e.g., MKWVTFISLLFLFSSAYSRGVFRR, SEQ ID NO:8)
d) the pre region of the HSA signal sequence (e.g., MKWVTFISLLFLFSSAYS, SEQ ID NO:9) or variants thereof, such as, for example, MKWVSFISLLFLFSSAYS, (SEQ ID NO:10)
e) the invertase signal sequence (e.g., MLLQAFLFLLAGFAAKISA, SEQ ID NO:11)
f) the yeast mating factor alpha signal sequence (e.g., MRFPSIFTAVLAFAASSALAAPVNTTTEDETAQIPAEAVIGYSDLEGDFDVAVLPFSNSTNNGLLFIN TTIASIAAKEEGVSLEKR, SEQ ID NO:12 or MRFPSIFTAVLAFAASSALAAPVNTTTEDETAQIPAEAVIGYSDLEGDFDVAVLPFSNSTNNGLLFIN TTIASIAAKEEGVSLDKR, SEQ ID NO:12)
g) *K. lactis* killer toxin leader sequence
h) a hybrid signal sequence (e.g., MKWVSFISLLFLFSSAYSRSLEKR, SEQ ID NO:13)
i) an HSA/MFα-1 hybrid signal sequence (also known as HSA/kex2) (e.g., MKWVSFISLLFLFSSAYSRSLDKR, SEQ ID NO:14)

j) a *K. lactis* killer/MFα-1 fusion leader sequence (e.g., MNIFYIFLFLLSFVQGSLDKR, SEQ ID NO:15)
k) the Immunoglobulin Ig signal sequence (e.g., MGWSCIILFLVATATGVHS, SEQ ID NO:16)
l) the Fibulin B precursor signal sequence (e.g., MERAAPSRRVPLPLLLLGGLALLAAGVDA, SEQ ID NO:17)
m) the clusterin precursor signal sequence (e.g., MMKTLLLFVGLLLTWESGQVLG, SEQ ID NO:18)
n) the insulin-like growth factor-binding protein 4 signal sequence (e.g., MLPLCLVAALLLAAGPGPSLG, SEQ ID NO:19)
o) variants of the pre-pro-region of the HSA signal sequence such as, for example,
 MKWVSFISLLFLFSSAYSRGVFRR (SEQ ID NO:20),
 MKWVTFISLLFLFAGVLG (SEQ ID NO:21),
 MKWVTFISLLFLFSGVLG (SEQ ID NO:22),
 MKWVTFISLLFLFGGVLG (SEQ ID NO:23),
 Modified HSA leader HSA #64—MKWVTFISLLFLFAGVSG (SEQ ID NO:24);
 Modified HSA leader HSA #66—MKWVTFISLLFLFGGVSG (SEQ ID NO:25);
 Modified HSA (A14) leader MKWVTFISLLFLFAGVSG (SEQ ID NO:26);
 Modified HSA (S14) leader (also known as modified HSA #65) MKWVTFISLLFLFSGVSG (SEQ ID NO:27),
 Modified HSA (G14) leader MKWVTFISLLFLFGGVSG (SEQ ID NO:28), or MKWVTFISLLFLFGGVLGDLHKS (SEQ ID NO:29)
p) a consensus signal sequence (MPTWAWWLFLVLLLALWAPARG, SEQ ID NO:30)
q) acid phosphatase (PH05) leader (e.g., MFKSVVYSILAASLANA SEQ ID NO:31)
r) the pre-sequence of MFoz-1
s) the pre-sequence of 0 glucanase (BGL2)
t) killer toxin leader
u) the presequence of killer toxin
v) *k. lactis* killer toxin prepro (29 amino acids; 16 amino acids of pre and 13 amino acids of pro) MNIFYIFLFLLSFVQGLEHTHRRGSLDKR (SEQ ID NO:32)
w) *S. diastaticus* glucoamylase I1 secretion leader sequence
x) *S. carlsbergensis* α-galactosidase (MEL1) secretion leader sequence
y) *Candida glucoamylase* leader sequence
z) The hybrid leaders disclosed in EP-A-387 319 (herein incorporated by reference)
aa) the gp67 signal sequence (in conjunction with baculoviral expression systems) (e.g., amino acids 1-19 of GenBank Accession Number AAA72759) or
bb) the natural leader of the therapeutic protein X;
cc) *S. cerevisiae* invertase (SUC2) leader, as disclosed in JP 62-096086 (granted as 911036516, herein incorporate by reference); or
dd) Inulinase—MKLAYSLLLPLAGVSASVINYKR (SEQ ID NO:33).
ee) A modified TA57 propeptide leader variant #1—MKLKTVRSAVLSSLFASQVLGQPIDDTESQTTSVNLMADDTESAFATQTNSGGLDVVGLISMAKR (SEQ ID NO:34)
ff) A modified TA57 propeptide leader variant #2—MKLKTVRSAVLSSLFASQVLGQPIDDTESQTTSVNLMADDTESAFATQTNSGGLDVVGLISMAEEG EPKR (SEQ ID NO:35)
gg) A consensus signal peptide—MWWRLWWLLLLLLLLWPMVWA (SEQ ID NO:99)
hh) A modified HSA/kex2 signal sequence—MKWVSFISLLFLFSSAYSGSLDKR (SEQ ID NO:100)
ii) A consensus signal peptide #2—MRPTWAWWLFLVLLLALWAPARG (SEQ ID NO:98)

Additional Methods of Recombinant and Synthetic Production of Albumin Fusion Proteins The present invention also relates to vectors containing a polynucleotide encoding an albumin fusion protein of the present invention, host cells, and the production of albumin fusion proteins by synthetic and recombinant techniques. The vector may be, for example, a phage, plasmid, viral, or retroviral vector. Retroviral vectors may be replication competent or replication defective. In the latter case, viral propagation generally will occur only in complementing host cells.

The polynucleotides encoding albumin fusion proteins of the invention may be joined to a vector containing a selectable marker for propagation in a host. Generally, a plasmid vector is introduced in a precipitate, such as a calcium phosphate precipitate, or in a complex with a charged lipid. If the vector is a virus, it may be packaged in vitro using an appropriate packaging cell line and then transduced into host cells.

The polynucleotide insert should be operatively linked to an appropriate promoter, such as the phage lambda PL promoter, the *E. coli* lac, trp, phoA and tac promoters, the SV40 early and late promoters and promoters of retroviral LTRs, to name a few. Other suitable promoters will be known to the skilled artisan. The expression constructs will further contain sites for transcription initiation, termination, and, in the transcribed region, a ribosome binding site for translation. The coding portion of the transcripts expressed by the constructs will preferably include a translation initiating codon at the beginning and a termination codon (UAA, UGA or UAG) appropriately positioned at the end of the polypeptide to be translated.

As indicated, the expression vectors will preferably include at least one selectable marker. Such markers include dihydrofolate reductase, G418, glutamine synthase, or neomycin resistance for eukaryotic cell culture, and tetracycline, kanamycin or ampicillin resistance genes for culturing in *E. coli* and other bacteria. Representative examples of appropriate hosts include, but are not limited to, bacterial cells, such as *E. coli, Streptomyces* and *Salmonella typhimurium* cells; fungal cells, such as yeast cells (e.g., *Saccharomyces cerevisiae* or *Pichia pastoris* (ATCC™ Accession No. 201178)); insect cells such as *Drosophila* S2 and *Spodoptera* Sf9 cells; animal cells such as CHO, COS, NSO, 293, and Bowes melanoma cells; and plant cells. Appropriate culture mediums and conditions for the above-described host cells are known in the art.

Among vectors preferred for use in bacteria include pQE70, pQE60 and pQE-9, available from QIAGEN, Inc.; pBluescript vectors, Phagescript vectors, pNH8A, pNH16a, pNH18A, pNH46A, available from Stratagene Cloning Systems, Inc.; and ptrc99a, pKK223-3, pKK233-3, pDR540, pRIT5 available from Pharmacia Biotech, Inc. Among preferred eukaryotic vectors are pWLNEO, pSV2CAT, pOG44, pXT1 and pSG available from Stratagene; and pSVK3, pBPV, pMSG and pSVL available from Pharmacia. Preferred expression vectors for use in yeast systems include, but are not limited to pYES2, pYD1, pTEF1/Zeo, pYES2/GS, pPICZ, pGAPZ, pGAPZalph, pPIC9, pPIC3.5, pHIL-D2, pHIL-S1, pPIC3.5K, pPIC9K, and PAO815 (all available from Invitrogen, Carlbad, Calif.). Other suitable vectors will be readily apparent to the skilled artisan.

In one embodiment, polynucleotides encoding an albumin fusion protein of the invention may be fused to signal sequences which will direct the localization of a protein of the invention to particular compartments of a prokaryotic or eukaryotic cell and/or direct the secretion of a protein of the invention from a prokaryotic or eukaryotic cell. For example, in *E. coli*, one may wish to direct the expression of the protein to the periplasmic space. Examples of signal sequences or proteins (or fragments thereof) to which the albumin fusion proteins of the invention may be fused in order to direct the expression of the polypeptide to the periplasmic space of bacteria include, but are not limited to, the pelB signal sequence, the maltose binding protein (MBP) signal sequence, MBP, the ompA signal sequence, the signal sequence of the periplasmic *E. coli* heat-labile enterotoxin B-subunit, and the signal sequence of alkaline phosphatase. Several vectors are commercially available for the construction of fusion proteins which will direct the localization of a protein, such as the pMAL series of vectors (particularly the pMAL-p series) available from New England Biolabs. In a specific embodiment, polynucleotides albumin fusion proteins of the invention may be fused to the pelB pectate lyase signal sequence to increase the efficiency of expression and purification of such polypeptides in Gram-negative bacteria. See, U.S. Pat. Nos. 5,576,195 and 5,846,818, the contents of which are herein incorporated by reference in their entireties.

Examples of signal peptides that may be fused to an albumin fusion protein of the invention in order to direct its secretion in mammalian cells include, but are not limited to:

a) the MPIF-1 signal sequence (e.g., amino acids 1-21 of GenBank Accession number AAB51134) MKVSVAALSCLMLVTALGSQA (SEQ ID NO:6)
b) the stanniocalcin signal sequence (MLQNSAVLLLLVISASA, SEQ ID NO:7)
c) the pre-pro region of the HSA signal sequence (e.g., MKWVTFISLLFLFSSAYSRGVFRR, SEQ ID NO: 8)
d) the pre region of the HSA signal sequence (e.g., MKWVTFISLLFLFSSAYS, SEQ ID NO:9) or variants thereof, such as, for example, MKWVSFISLLFLFSSAYS, (SEQ ID NO:10)
e) the invertase signal sequence (e.g., MLLQAFLFLLAGFAAKISA, SEQ ID NO:11)
f) the yeast mating factor alpha signal sequence (e.g., MRFPSIFTAVLAFAASSALAAPVNTTTEDETAQIPAEAVIGYSDLEGDFDVAVLPFSNSTNNGLLFIN TTIASIAAKEEGVSLEKR, SEQ ID NO:12 or MRFPSIFTAVLAFAASSALAAPVNTTTEDETAQIPAEAVIGYSDLEGDFDVAVLPFSNSTNNGLLFIN TTIASIAAKEEGVSLDKR, SEQ ID NO:12)
g) *K. lactis* killer toxin leader sequence
h) a hybrid signal sequence (e.g., MKWVSFISLLFLFSSAYSRSLEKR, SEQ ID NO:13)
i) an HSA/MFα-1 hybrid signal sequence (also known as HSA/kex2) (e.g., MKWVSFISLLFLFSSAYSRSLDKR, SEQ ID NO:14)
j) a *K. lactis* killer/MFα-1 fusion leader sequence (e.g., MNIFYIFLFLLSFVQGSLDKR, SEQ ID NO:15)
k) the Immunoglobulin Ig signal sequence (e.g., MGWSCIILFLVATATGVHS, SEQ ID NO:16)
l) the Fibulin B precursor signal sequence (e.g., MERAAPSRRVPLPLLLLGGLALLAAGVDA, SEQ ID NO:17)
m) the clusterin precursor signal sequence (e.g., MMKTLLLFVGLLLTWESGQVLG, SEQ ID NO:18)
n) the insulin-like growth factor-binding protein 4 signal sequence (e.g., MLPLCLVAALLLAAGPGPSLG, SEQ ID NO:19)
o) variants of the pre-pro-region of the HSA signal sequence such as, for example,
 MKWVSFISLLFLFSSAYSRGVFRR (SEQ ID NO:20),
 MKWVTFISLLFLFAGVLG (SEQ ID NO:21),
 MKWVTFISLLFLFSGVLG (SEQ ID NO:22),
 MKWVTFISLLFLFGGVLG (SEQ ID NO:23),
 Modified HSA leader HSA #64—MKWVTFISLLFLFAGVSG (SEQ ID NO:24);
 Modified HSA leader HSA #66—MKWVTFISLLFLFGGVSG (SEQ ID NO:25);
 Modified HSA (A14) leader MKWVTFISLLFLFAGVSG (SEQ ID NO:26);
 Modified HSA (S14) leader (also known as modified HSA #65) MKWVTFISLLFLFSGVSG (SEQ ID NO:27),
 Modified HSA (G14) leader MKWVTFISLLFLFGGVSG (SEQ ID NO:28), or MKWVTFISLLFLFGGVLGDLHKS (SEQ ID NO:29)
p) a consensus signal sequence (MPTWAWWLFLVLLLALWAPARG, SEQ ID NO:30)
q) acid phosphatase (PH05) leader (e.g., MFKSVVYSILAASLANA SEQ ID NO:31)
r) the pre-sequence of MFoz-1
s) the pre-sequence of 0 glucanase (BGL2)
t) killer toxin leader
u) the presequence of killer toxin
v) *k. lactis* killer toxin prepro (29 amino acids; 16 amino acids of pre and 13 amino acids of pro) MNIFYIFLFLLSFVQGLEHTHRRGSLDKR (SEQ ID NO:32)
w) *S. diastaticus* glucoamylase I1 secretion leader sequence
x) *S. carlsbergensis* α-galactosidase (MEL1) secretion leader sequence
y) *Candida glucoamylase* leader sequence
z) The hybrid leaders disclosed in EP-A-3 87 319 (herein incorporated by reference)
aa) the gp67 signal sequence (in conjunction with baculoviral expression systems) (e.g., amino acids 1-19 of GenBank Accession Number AAA72759) or
bb) the natural leader of the therapeutic protein X;
cc) *S. cerevisiae* invertase (SUC2) leader, as disclosed in JP 62-096086 (granted as 911036516, herein incorporate by reference); or
dd) Inulinase—MKLAYSLLLPLAGVSASVINYKR (SEQ ID NO:33).
ee) A modified TA57 propeptide leader variant #1—MKLKTVRSAVLSSLFASQVLGQPIDDTESQTTSVNLMADDTESAFATQTNSGGLDVVGLISMAKR (SEQ ID NO:34)
ff) A modified TA57 propeptide leader variant #2—MKLKTVRSAVLSSLFASQVLGQPIDDTESQTTSVNLMADDTESAFATQTNSGGLDVVGLISMAEEG EPKR (SEQ ID NO:35)
gg) A consensus signal peptide—MWWRLWWLLLLLLLLWPMVWA (SEQ ID NO:99)
jj) A modified HSA/kex2 signal sequence—MKWVSFISLLFLFSSAYSGSLDKR (SEQ ID NO:100)
kk) A consensus signal peptide #2—MRPTWAWWLFLVLLLALWAPARG (SEQ ID NO:98)

In a preferred embodiment, the modified HSA/kex2 signal sequence (SEQ ID NO:100) is fused to the amino terminus of an albumin fusion protein, including fusion proteins comprising albumin and a therapeutic protein as described herein, as well as albumin fusion proteins disclosed in WO93/15199; WO97/24445; WO03/60071; WO03/59934; and PCT/US04/01369, each of which are incorporated herein by reference in their entireties. The modified HSA/kex2 signal sequence is based on the HSA/kex2 signal sequence (SEQ ID NO:14) disclosed, e.g., in Sleep et al., Biotechnology 1990, vol. 8, pp. 42-46; and U.S. Pat. No. 5,302,697, both of which are incorporated herein by reference in their entireties. The modified HSA/kex2 leader sequence disclosed herein contains a non-conservative amino acid substitution (Arg to Gly) at residue 19 of the parent signal peptide. The modified HSA/kex2 signal peptide has been found to produce unexpectedly better expression yield and/or better cleavage efficiency of albumin fusion proteins when expressed in yeast than the unmodified HSA/kex2 signal sequence. Variants of the modified HSA/kex2 signal peptide are also encompassed by the invention. In particular the Gly residue at position 19 of SEQ ID NO:100 may be substituted with a Pro residue. Other conservative substitution variants of the modified HSA/kex2 signal sequence are also contemplated. Nucleic acids encoding the modified HSA/kex2 signal sequence of SEQ ID NO:100, as well as conservative substitution variants thereof, are also encompassed by the invention.

Vectors which use glutamine synthase (GS) or DHFR as the selectable markers can be amplified in the presence of the drugs methionine sulphoximine or methotrexate, respectively. An advantage of glutamine synthase based vectors are the availability of cell lines (e.g., the murine myeloma cell line, NS0) which are glutamine synthase negative. Glutamine synthase expression systems can also function in glutamine synthase expressing cells (e.g., Chinese Hamster Ovary (CHO) cells) by providing additional inhibitor to prevent the functioning of the endogenous gene. A glutamine synthase expression system and components thereof are detailed in PCT publications: WO87/04462; WO86/05807; WO89/01036; WO89/10404; and WO91/06657, which are hereby incorporated in their entireties by reference herein. Additionally, glutamine synthase expression vectors can be obtained from Lonza Biologics, Inc. (Portsmouth, N.H.). Expression and production of monoclonal antibodies using a GS expression system in murine myeloma cells is described in Bebbington et al., *Bio/technology* 10:169 (1992) and in Biblia and Robinson *Biotechnol. Prog.* 11:1 (1995) which are herein incorporated by reference.

The present invention also relates to host cells containing the above-described vector constructs described herein, and additionally encompasses host cells containing nucleotide sequences of the invention that are operably associated with one or more heterologous control regions (e.g., promoter and/or enhancer) using techniques known of in the art. The host cell can be a higher eukaryotic cell, such as a mammalian cell (e.g., a human derived cell), or a lower eukaryotic cell, such as a yeast cell, or the host cell can be a prokaryotic cell, such as a bacterial cell. A host strain may be chosen which modulates the expression of the inserted gene sequences, or modifies and processes the gene product in the specific fashion desired. Expression from certain promoters can be elevated in the presence of certain inducers; thus expression of the genetically engineered polypeptide may be controlled. Furthermore, different host cells have characteristics and specific mechanisms for the translational and post-translational processing and modification (e.g., phosphorylation, cleavage) of proteins. Appropriate cell lines can be chosen to ensure the desired modifications and processing of the foreign protein expressed.

Introduction of the nucleic acids and nucleic acid constructs of the invention into the host cell can be effected by calcium phosphate transfection, DEAE-dextran mediated transfection, cationic lipid-mediated transfection, electroporation, transduction, infection, or other methods. Such methods are described in many standard laboratory manuals, such as Davis et al., Basic Methods In Molecular Biology (1986). It is specifically contemplated that the polypeptides of the present invention may in fact be expressed by a host cell lacking a recombinant vector.

In addition to encompassing host cells containing the vector constructs discussed herein, the invention also encompasses primary, secondary, and immortalized host cells of vertebrate origin, particularly mammalian origin, that have been engineered to delete or replace endogenous genetic material (e.g., the coding sequence corresponding to a Therapeutic protein may be replaced with an albumin fusion protein corresponding to the Therapeutic protein), and/or to include genetic material (e.g., heterologous polynucleotide sequences such as for example, an albumin fusion protein of the invention corresponding to the Therapeutic protein may be included). The genetic material operably associated with the endogenous polynucleotide may activate, alter, and/or amplify endogenous polynucleotides.

In addition, techniques known in the art may be used to operably associate heterologous polynucleotides (e.g., polynucleotides encoding an albumin protein, or a fragment or variant thereof) and/or heterologous control regions (e.g., promoter and/or enhancer) with endogenous polynucleotide sequences encoding a Therapeutic protein via homologous recombination (see, e.g., U.S. Pat. No. 5,641,670, issued Jun. 24, 1997; International Publication Number WO 96/29411; International Publication Number WO 94/12650; Koller et al., *Proc. Natl. Acad. Sci. USA* 86:8932-8935 (1989); and Zijlstra et al., *Nature* 342:435-438 (1989), the disclosures of each of which are incorporated by reference in their entireties).

Albumin fusion proteins of the invention can be recovered and purified from recombinant cell cultures by well-known methods including ammonium sulfate or ethanol precipitation, acid extraction, anion or cation exchange chromatography, phosphocellulose chromatography, hydrophobic interaction chromatography, affinity chromatography, hydroxylapatite chromatography, hydrophobic charge interaction chromatography and lectin chromatography. Most preferably, high performance liquid chromatography ("HPLC") is employed for purification.

In preferred embodiments the albumin fusion proteins of the invention are purified using Anion Exchange Chromatography including, but not limited to, chromatography on Q-sepharose, DEAE sepharose, poros HQ, poros DEAE, Toyopearl Q, Toyopearl QAE, Toyopearl DEAE, Resource/Source Q and DEAE, Fractogel Q and DEAE columns.

In specific embodiments the albumin fusion proteins of the invention are purified using Cation Exchange Chromatography including, but not limited to, SP-sepharose, CM sepharose, poros HS, poros CM, Toyopearl SP, Toyopearl CM, Resource/Source S and CM, Fractogel S and CM columns and their equivalents and comparables.

In specific embodiments the albumin fusion proteins of the invention are purified using Hydrophobic Interaction Chromatography including, but not limited to, Phenyl, Butyl, Methyl, Octyl, Hexyl-sepharose, poros Phenyl, Butyl, Methyl, Octyl, Hexyl, Toyopearl Phenyl, Butyl, Methyl, Octyl, Hexyl Resource/Source Phenyl, Butyl, Methyl, Octyl, Hexyl, Fractogel Phenyl, Butyl, Methyl, Octyl, Hexyl columns and their equivalents and comparables.

In specific embodiments the albumin fusion proteins of the invention are purified using Size Exclusion Chromatography including, but not limited to, sepharose S100, S200, S300, superdex resin columns and their equivalents and comparables.

In specific embodiments the albumin fusion proteins of the invention are purified using Affinity Chromatography including, but not limited to, Mimetic Dye affinity, peptide affinity and antibody affinity columns that are selective for either the HSA or the "fusion target" molecules.

In preferred embodiments albumin fusion proteins of the invention are purified using one or more Chromatography methods listed above. In other preferred embodiments, albumin fusion proteins of the invention are purified using one or more of the following Chromatography columns, Q sepharose FF column, SP Sepharose FF column, Q Sepharose High Performance Column, Blue Sepharose FF column, Blue Column, Phenyl Sepharose FF column, DEAE Sepharose FF, or Methyl Column.

Additionally, albumin fusion proteins of the invention may be purified using the process described in PCT International Publication WO 00/44772 which is herein incorporated by reference in its entirety. One of skill in the art could easily modify the process described therein for use in the purification of albumin fusion proteins of the invention.

Albumin fusion proteins of the present invention may be recovered from: products of chemical synthetic procedures; and products produced by recombinant techniques from a prokaryotic or eukaryotic host, including, for example, bacterial, yeast, higher plant, insect, and mammalian cells. Depending upon the host employed in a recombinant production procedure, the polypeptides of the present invention may be glycosylated or may be non-glycosylated. In addition, albumin fusion proteins of the invention may also include an initial modified methionine residue, in some cases as a result of host-mediated processes. Thus, it is well known in the art that the N-terminal methionine encoded by the translation initiation codon generally is removed with high efficiency from any protein after translation in all eukaryotic cells. While the N-terminal methionine on most proteins also is efficiently removed in most prokaryotes, for some proteins, this prokaryotic removal process is inefficient, depending on the nature of the amino acid to which the N-terminal methionine is covalently linked.

In one embodiment, the yeast *Pichia pastoris* is used to express albumin fusion proteins of the invention in a eukaryotic system. *Pichia pastoris* is a methylotrophic yeast which can metabolize methanol as its sole carbon source. A main step in the methanol metabolization pathway is the oxidation of methanol to formaldehyde using $O_2$. This reaction is catalyzed by the enzyme alcohol oxidase. In order to metabolize methanol as its sole carbon source, *Pichia pastoris* must generate high levels of alcohol oxidase due, in part, to the relatively low affinity of alcohol oxidase for $O_2$. Consequently, in a growth medium depending on methanol as a main carbon source, the promoter region of one of the two alcohol oxidase genes (AOX1) is highly active. In the presence of methanol, alcohol oxidase produced from the AOX1 gene comprises up to approximately 30% of the total soluble protein in *Pichia pastoris*. See Ellis, S. B., et al., *Mol. Cell. Biol.* 5:1111-21 (1985); Koutz, P. J, et al., *Yeast* 5:167-77 (1989); Tschopp, J. F., et al., *Nucl. Acids Res.* 15:3859-76 (1987). Thus, a heterologous coding sequence, such as, for example, a polynucleotide of the present invention, under the transcriptional regulation of all or part of the AOX1 regulatory sequence is expressed at exceptionally high levels in *Pichia* yeast grown in the presence of methanol.

In one example, the plasmid vector pPIC9K is used to express DNA encoding an albumin fusion protein of the invention, as set forth herein, in a *Pichea* yeast system essentially as described in "*Pichia* Protocols: Methods in Molecular Biology," D. R. Higgins and J. Cregg, eds. The Humana Press, Totowa, N.J., 1998. This expression vector allows expression and secretion of a polypeptide of the invention by virtue of the strong AOX1 promoter linked to the *Pichia pastoris* alkaline phosphatase (PHO) secretory signal peptide (i.e., leader) located upstream of a multiple cloning site.

Many other yeast vectors could be used in place of pPIC9K, such as, pYES2, pYD1, pTEF1/Zeo, pYES2/GS, pPICZ, pGAPZ, pGAPZalpha, pPIC9, pPIC3.5, pHIL-D2, pHIL-S1, pPIC3.5K, and PAO815, as one skilled in the art would readily appreciate, as long as the proposed expression construct provides appropriately located signals for transcription, translation, secretion (if desired), and the like, including an in-frame AUG as required.

In another embodiment, high-level expression of a heterologous coding sequence, such as, for example, a polynucleotide encoding an albumin fusion protein of the present invention, may be achieved by cloning the heterologous polynucleotide of the invention into an expression vector such as, for example, pGAPZ or pGAPZalpha, and growing the yeast culture in the absence of methanol.

In addition, albumin fusion proteins of the invention can be chemically synthesized using techniques known in the art (e.g., see Creighton, 1983, Proteins: Structures and Molecular Principles, W.H. Freeman & Co., N.Y., and Hunkapiller et al., *Nature,* 310:105-111 (1984)). For example, a polypeptide corresponding to a fragment of a polypeptide can be synthesized by use of a peptide synthesizer. Furthermore, if desired, nonclassical amino acids or chemical amino acid analogs can be introduced as a substitution or addition into the polypeptide sequence. Non-classical amino acids include, but are not limited to, to the D-isomers of the common amino acids, 2,4-diaminobutyric acid, a-amino isobutyric acid, 4-aminobutyric acid, Abu, 2-amino butyric acid, g-Abu, e-Ahx, 6-amino hexanoic acid, Aib, 2-amino isobutyric acid, 3-amino propionic acid, ornithine, norleucine, norvaline, hydroxyproline, sarcosine, citrulline, homocitrulline, cysteic acid, t-butylglycine, t-butylalanine, phenylglycine, cyclohexylalanine, b-alanine, fluoro-amino acids, designer amino acids such as b-methyl amino acids, Ca-methyl amino acids, Na-methyl amino acids, and amino acid analogs in general. Furthermore, the amino acid can be D (dextrorotary) or L (levorotary).

The invention encompasses albumin fusion proteins of the present invention which are differentially modified during or after translation, e.g., by glycosylation, acetylation, phosphorylation, amidation, derivatization by known protecting/blocking groups, proteolytic cleavage, linkage to an antibody molecule or other cellular ligand, etc. Any of numerous chemical modifications may be carried out by known techniques, including but not limited, to specific chemical cleavage by cyanogen bromide, trypsin, chymotrypsin, papain, V8 protease, $NaBH_4$; acetylation, formylation, oxidation, reduction; metabolic synthesis in the presence of tunicamycin; etc.

Additional post-translational modifications encompassed by the invention include, for example, e.g., N-linked or O-linked carbohydrate chains, processing of N-terminal or C-terminal ends), attachment of chemical moieties to the amino acid backbone, chemical modifications of N-linked or O-linked carbohydrate chains, and addition or deletion of an N-terminal methionine residue as a result of procaryotic host cell expression. The albumin fusion proteins may also be modified with a detectable label, such as an enzymatic, fluorescent, isotopic or affinity label to allow for detection and isolation of the protein.

Examples of suitable enzymes include horseradish peroxidase, alkaline phosphatase, beta-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin; and examples of suitable radioactive material include iodine ($^{121}$I, $^{123}$I, $^{125}$I, $^{131}$I), carbon ($^{14}$C), sulfur ($^{35}$S), tritium ($^{3}$H), indium ($^{111}$In, $^{112}$In, $^{113m}$In, $^{115m}$In), technetium ($^{99}$Tc, $^{99m}$Tc), thallium ($^{201}$Ti), gallium ($^{68}$Ga, $^{67}$Ga), palladium ($^{103}$Pd), molybdenum ($^{99}$Mo), xenon ($^{133}$Xe), fluorine ($^{18}$F), $^{153}$Sm, $^{177}$Lu, $^{159}$Gd, $^{149}$Pm, $^{140}$La, $^{175}$Yb, $^{166}$Ho, $^{90}$Y, $^{47}$S, $^{186}$R, $^{188}$Re, $^{142}$Pr, $^{105}$Rh and $^{97}$Ru.

In specific embodiments, albumin fusion proteins of the present invention or fragments or variants thereof are attached to macrocyclic chelators that associate with radiometal ions, including but not limited to, $^{177}$Lu, $^{90}$Y, $^{166}$Ho, and $^{153}$Sm, to polypeptides. In a preferred embodiment, the radiometal ion associated with the macrocyclic chelators is $^{111}$In. In another preferred embodiment, the radiometal ion associated with the macrocyclic chelator is $^{90}$Y. In specific embodiments, the macrocyclic chelator is 1,4,7,10-tetraazacyclododecane-N,N',N",N'"-tetraacetic acid (DOTA). In other specific embodiments, DOTA is attached to an antibody of the invention or fragment thereof via linker molecule. Examples of linker molecules useful for conjugating DOTA to a polypeptide are commonly known in the art—see, for example, DeNardo et al., Clin Cancer Res. 4(10):2483-90 (1998); Peterson et al., Bioconjug. Chem. 10(4):553-7 (1999); and Zimmerman et al, Nucl. Med. Biol. 26(8):943-50 (1999); which are hereby incorporated by reference in their entirety.

As mentioned, the albumin fusion proteins of the invention may be modified by either natural processes, such as post-translational processing, or by chemical modification techniques which are well known in the art. It will be appreciated that the same type of modification may be present in the same or varying degrees at several sites in a given polypeptide. Polypeptides of the invention may be branched, for example, as a result of ubiquitination, and they may be cyclic, with or without branching. Cyclic, branched, and branched cyclic polypeptides may result from posttranslation natural processes or may be made by synthetic methods. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent cross-links, formation of cysteine, formation of pyroglutamate, formylation, gamma-carboxylation, glycosylation, GPI anchor formation, hydroxylation, iodination, methylation, myristylation, oxidation, pegylation, proteolytic processing, phosphorylation, prenylation, racemization, selenoylation, sulfation, transfer-RNA mediated addition of amino acids to proteins such as arginylation, and ubiquitination. (See, for instance, PROTEINS—STRUCTURE AND MOLECULAR PROPERTIES, 2nd Ed., T. E. Creighton, W. H. Freeman and Company, New York (1993); POST-TRANSLATIONAL COVALENT MODIFICATION OF PROTEINS, B. C. Johnson, Ed., Academic Press, New York, pgs. 1-12 (1983); Seifter et al., Meth. Enzymol. 182: 626-646 (1990); Rattan et al., Ann. N.Y. Acad. Sci. 663:48-62 (1992)).

Albumin fusion proteins of the invention and antibodies that bind a Therapeutic protein or fragments or variants thereof can be fused to marker sequences, such as a peptide to facilitate purification. In preferred embodiments, the marker amino acid sequence is a hexa-histidine peptide, such as the tag provided in a pQE vector (QIAGEN, Inc., 9259 Eton Avenue, Chatsworth, Calif., 91311), among others, many of which are commercially available. As described in Gentz et al., Proc. Natl. Acad. Sci. USA 86:821-824 (1989), for instance, hexa-histidine provides for convenient purification of the fusion protein. Other peptide tags useful for purification include, but are not limited to, the "HA" tag, which corresponds to an epitope derived from the influenza hemagglutinin protein (Wilson et al., Cell 37:767 (1984)) and the "flag" tag.

Further, an albumin fusion protein of the invention may be conjugated to a therapeutic moiety such as a cytotoxin, e.g., a cytostatic or cytocidal agent, a therapeutic agent or a radioactive metal ion, e.g., alpha-emitters such as, for example, 213Bi. A cytotoxin or cytotoxic agent includes any agent that is detrimental to cells. Examples include paclitaxol, cytochalasin B, gramicidin D, ethidium bromide, emetine, mitomycin, etoposide, tenoposide, vincristine, vinblastine, colchicin, doxorubicin, daunorubicin, dihydroxy anthracin dione, mitoxantrone, mithramycin, actinomycin D, 1-dehydrotestosterone, glucocorticoids, procaine, tetracaine, lidocaine, propranolol, and puromycin and analogs or homologs thereof. Therapeutic agents include, but are not limited to, antimetabolites (e.g., methotrexate, 6-mercaptopurine, 6-thioguanine, cytarabine, 5-fluorouracil decarbazine), alkylating agents (e.g., mechlorethamine, thioepa chlorambucil, melphalan, carmustine (BSNU) and lomustine (CCNU), cyclothosphamide, busulfan, dibromomannitol, streptozotocin, mitomycin C, and cis-dichlorodiamine platinum (II) (DDP) cisplatin), anthracyclines (e.g., daunorubicin (formerly daunomycin) and doxorubicin), antibiotics (e.g., dactinomycin (formerly actinomycin), bleomycin, mithramycin, and anthramycin (AMC)), and anti-mitotic agents (e.g., vincristine and vinblastine).

The conjugates of the invention can be used for modifying a given biological response, the therapeutic agent or drug moiety is not to be construed as limited to classical chemical therapeutic agents. For example, the drug moiety may be a protein or polypeptide possessing a desired biological activity. Such proteins may include, for example, a toxin such as abrin, ricin A, pseudomonas exotoxin, or diphtheria toxin; a protein such as tumor necrosis factor, alpha-interferon, β-interferon, nerve growth factor, platelet derived growth factor, tissue plasminogen activator, an apoptotic agent, e.g., TNF-alpha, TNF-beta, AIM I (See, International Publication No. WO 97/33899), AIM II (See, International Publication No. WO 97/34911), Fas Ligand (Takahashi et al., *Int. Immunol.,* 6:1567-1574 (1994)), VEGI (See, International Publication No. WO 99/23105), a thrombotic agent or an anti-angiogenic agent, e.g., angiostatin or endostatin; or, biological response modifiers such as, for example, lymphokines, interleukin-1 ("IL-1"), interleukin-2 ("IL-2"), interleukin-6 ("IL-6"), granulocyte macrophage colony stimulating factor ("GM-CSF"), granulocyte colony stimulating factor ("G-CSF"), or other growth factors. Techniques for conjugating such therapeutic moiety to proteins (e.g., albumin fusion proteins) are well known in the art.

Albumin fusion proteins may also be attached to solid supports, which are particularly useful for immunoassays or purification of polypeptides that are bound by, that bind to, or associate with albumin fusion proteins of the invention. Such solid supports include, but are not limited to, glass, cellulose, polyacrylamide, nylon, polystyrene, polyvinyl chloride or polypropylene.

Albumin fusion proteins, with or without a therapeutic moiety conjugated to it, administered alone or in combination with cytotoxic factor(s) and/or cytokine(s) can be used as a therapeutic.

In embodiments where the albumin fusion protein of the invention comprises only the VH domain of an antibody that binds a Therapeutic protein, it may be necessary and/or desirable to coexpress the fusion protein with the VL domain of the same antibody that binds a Therapeutic protein, such that the VH-albumin fusion protein and VL protein will associate (either covalently or non-covalently) post-translationally.

In embodiments where the albumin fusion protein of the invention comprises only the VL domain of an antibody that binds a Therapeutic protein, it may be necessary and/or desirable to coexpress the fusion protein with the VH domain of the same antibody that binds a Therapeutic protein, such that the VL-albumin fusion protein and VH protein will associate (either covalently or non-covalently) post-translationally.

Some Therapeutic antibodies are bispecific antibodies, meaning the antibody that binds a Therapeutic protein is an artificial hybrid antibody having two different heavy/light chain pairs and two different binding sites. In order to create an albumin fusion protein corresponding to that Therapeutic protein, it is possible to create an albumin fusion protein which has an scFv fragment fused to both the N- and C-terminus of the albumin protein moiety. More particularly, the scFv fused to the N-terminus of albumin would correspond to one of the heavy/light (VH/VL) pairs of the original antibody that binds a Therapeutic protein and the scFv fused to the C-terminus of albumin would correspond to the other heavy/light (VH/VL) pair of the original antibody that binds a Therapeutic protein.

Also provided by the invention are chemically modified derivatives of the albumin fusion proteins of the invention which may provide additional advantages such as increased solubility, stability and circulating time of the polypeptide, or decreased immunogenicity (see U.S. Pat. No. 4,179,337). The chemical moieties for derivitization may be selected from water soluble polymers such as polyethylene glycol, ethylene glycol/propylene glycol copolymers, carboxymethylcellulose, dextran, polyvinyl alcohol and the like. The albumin fusion proteins may be modified at random positions within the molecule, or at predetermined positions within the molecule and may include one, two, three or more attached chemical moieties.

The polymer may be of any molecular weight, and may be branched or unbranched. For polyethylene glycol, the preferred molecular weight is between about 1 kDa and about 100 kDa (the term "about" indicating that in preparations of polyethylene glycol, some molecules will weigh more, some less, than the stated molecular weight) for ease in handling and manufacturing. Other sizes may be used, depending on the desired therapeutic profile (e.g., the duration of sustained release desired, the effects, if any on biological activity, the ease in handling, the degree or lack of antigenicity and other known effects of the polyethylene glycol to a Therapeutic protein or analog). For example, the polyethylene glycol may have an average molecular weight of about 200, 500, 1000, 1500, 2000, 2500, 3000, 3500, 4000, 4500, 5000, 5500, 6000, 6500, 7000, 7500, 8000, 8500, 9000, 9500, 10,000, 10,500, 11,000, 11,500, 12,000, 12,500, 13,000, 13,500, 14,000, 14,500, 15,000, 15,500, 16,000, 16,500, 17,000, 17,500, 18,000, 18,500, 19,000, 19,500, 20,000, 25,000, 30,000, 35,000, 40,000, 45,000, 50,000, 55,000, 60,000, 65,000, 70,000, 75,000, 80,000, 85,000, 90,000, 95,000, or 100,000 kDa.

As noted above, the polyethylene glycol may have a branched structure. Branched polyethylene glycols are described, for example, in U.S. Pat. No. 5,643,575; Morpurgo et al., *Appl. Biochem. Biotechnol.* 56:59-72 (1996); Vorobjev et al., *Nucleosides Nucleotides* 18:2745-2750 (1999); and Caliceti et al., *Bioconjug. Chem.* 10:638-646 (1999), the disclosures of each of which are incorporated herein by reference.

The polyethylene glycol molecules (or other chemical moieties) should be attached to the protein with consideration of effects on functional or antigenic domains of the protein. There are a number of attachment methods available to those skilled in the art, such as, for example, the method disclosed in EP 0 401 384 (coupling PEG to G-CSF), herein incorporated by reference; see also Malik et al., Exp. Hematol. 20:1028-1035 (1992), reporting pegylation of GM-CSF using tresyl chloride. For example, polyethylene glycol may be covalently bound through amino acid residues via reactive group, such as a free amino or carboxyl group. Reactive groups are those to which an activated polyethylene glycol molecule may be bound. The amino acid residues having a free amino group may include lysine residues and the N-terminal amino acid residues; those having a free carboxyl group may include aspartic acid residues glutamic acid residues and the C-terminal amino acid residue. Sulfhydryl groups may also be used as a reactive group for attaching the polyethylene glycol molecules. Preferred for therapeutic purposes is attachment at an amino group, such as attachment at the N-terminus or lysine group.

As suggested above, polyethylene glycol may be attached to proteins via linkage to any of a number of amino acid residues. For example, polyethylene glycol can be linked to proteins via covalent bonds to lysine, histidine, aspartic acid, glutamic acid, or cysteine residues. One or more reaction chemistries may be employed to attach polyethylene glycol to specific amino acid residues (e.g., lysine, histidine, aspartic acid, glutamic acid, or cysteine) of the protein or to more than one type of amino acid residue (e.g., lysine, histidine, aspartic acid, glutamic acid, cysteine and combinations thereof) of the protein.

One may specifically desire proteins chemically modified at the N-terminus. Using polyethylene glycol as an illustration of the present composition, one may select from a variety of polyethylene glycol molecules (by molecular weight, branching, etc.), the proportion of polyethylene glycol molecules to protein (polypeptide) molecules in the reaction mix, the type of pegylation reaction to be performed, and the method of obtaining the selected N-terminally pegylated protein. The method of obtaining the N-terminally pegylated preparation (i.e., separating this moiety from other monopegylated moieties if necessary) may be by purification of the N-terminally pegylated material from a population of pegylated protein molecules. Selective proteins chemically modified at the N-terminus modification may be accomplished by reductive alkylation which exploits differential reactivity of different types of primary amino groups (lysine versus the N-terminal) available for derivatization in a particular protein. Under the appropriate reaction conditions, substantially selective derivatization of the protein at the N-terminus with a carbonyl group containing polymer is achieved.

As indicated above, pegylation of the albumin fusion proteins of the invention may be accomplished by any number of means. For example, polyethylene glycol may be attached to the albumin fusion protein either directly or by an intervening linker. Linkerless systems for attaching polyethylene glycol to proteins are described in Delgado et al., Crit. Rev. Thera. Drug Carrier Sys. 9:249-304 (1992); Francis et al., Intern. J.

of Hematol. 68:1-18 (1998); U.S. Pat. No. 4,002,531; U.S. Pat. No. 5,349,052; WO 95/06058; and WO 98/32466, the disclosures of each of which are incorporated herein by reference.

One system for attaching polyethylene glycol directly to amino acid residues of proteins without an intervening linker employs tresylated MPEG, which is produced by the modification of monmethoxy polyethylene glycol (MPEG) using tresylchloride ($ClSO_2CH_2CF_3$). Upon reaction of protein with tresylated MPEG, polyethylene glycol is directly attached to amine groups of the protein. Thus, the invention includes protein-polyethylene glycol conjugates produced by reacting proteins of the invention with a polyethylene glycol molecule having a 2,2,2-trifluoreothane sulphonyl group.

Polyethylene glycol can also be attached to proteins using a number of different intervening linkers. For example, U.S. Pat. No. 5,612,460, the entire disclosure of which is incorporated herein by reference, discloses urethane linkers for connecting polyethylene glycol to proteins. Protein-polyethylene glycol conjugates wherein the polyethylene glycol is attached to the protein by a linker can also be produced by reaction of proteins with compounds such as MPEG-succinimidylsuccinate, MPEG activated with 1,1'-carbonyldiimidazole, MPEG-2,4,5-trichloropenylcarbonate, MPEG-p-nitrophenolcarbonate, and various MPEG-succinate derivatives. A number of additional polyethylene glycol derivatives and reaction chemistries for attaching polyethylene glycol to proteins are described in International Publication No. WO 98/32466, the entire disclosure of which is incorporated herein by reference. Pegylated protein products produced using the reaction chemistries set out herein are included within the scope of the invention.

The number of polyethylene glycol moieties attached to each albumin fusion protein of the invention (i.e., the degree of substitution) may also vary. For example, the pegylated proteins of the invention may be linked, on average, to 1, 2, 3, 4, 5, 6, 7, 8, 9, 10, 12, 15, 17, 20, or more polyethylene glycol molecules. Similarly, the average degree of substitution within ranges such as 1-3, 2-4, 3-5, 4-6, 5-7, 6-8, 7-9, 8-10, 9-11, 10-12, 11-13, 12-14, 13-15, 14-16, 15-17, 16-18, 17-19, or 18-20 polyethylene glycol moieties per protein molecule. Methods for determining the degree of substitution are discussed, for example, in Delgado et al., Crit. Rev. Thera. Drug Carrier Sys. 9:249-304 (1992).

The polypeptides of the invention can be recovered and purified from chemical synthesis and recombinant cell cultures by standard methods which include, but are not limited to, ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Most preferably, high performance liquid chromatography ("HPLC") is employed for purification. Well known techniques for refolding protein may be employed to regenerate active conformation when the polypeptide is denatured during isolation and/or purification.

The presence and quantity of albumin fusion proteins of the invention may be determined using ELISA, a well known immunoassay known in the art. In one ELISA protocol that would be useful for detecting/quantifying albumin fusion proteins of the invention, comprises the steps of coating an ELISA plate with an anti-human serum albumin antibody, blocking the plate to prevent non-specific binding, washing the ELISA plate, adding a solution containing the albumin fusion protein of the invention (at one or more different concentrations), adding a secondary anti-Therapeutic protein specific antibody coupled to a detectable label (as described herein or otherwise known in the art), and detecting the presence of the secondary antibody. In an alternate version of this protocol, the ELISA plate might be coated with the anti-Therapeutic protein specific antibody and the labeled secondary reagent might be the anti-human albumin specific antibody.

Uses of the Polynucleotides

Each of the polynucleotides identified herein can be used in numerous ways as reagents. The following description should be considered exemplary and utilizes known techniques.

The polynucleotides of the present invention are useful to produce the albumin fusion proteins of the invention. As described in more detail below, polynucleotides of the invention (encoding albumin fusion proteins) may be used in recombinant DNA methods useful in genetic engineering to make cells, cell lines, or tissues that express the albumin fusion protein encoded by the polynucleotides encoding albumin fusion proteins of the invention.

Polynucleotides of the present invention are also useful in gene therapy. One goal of gene therapy is to insert a normal gene into an organism having a defective gene, in an effort to correct the genetic defect. The polynucleotides disclosed in the present invention offer a means of targeting such genetic defects in a highly accurate manner. Another goal is to insert a new gene that was not present in the host genome, thereby producing a new trait in the host cell. Additional non-limiting examples of gene therapy methods encompassed by the present invention are more thoroughly described elsewhere herein (see, e.g., the sections labeled "Gene Therapy", and Examples 61 and 62).

Uses of the Polypeptides

Each of the polypeptides identified herein can be used in numerous ways. The following description should be considered exemplary and utilizes known techniques.

Albumin fusion proteins of the invention are useful to provide immunological probes for differential identification of the tissue(s) (e.g., immunohistochemistry assays such as, for example, ABC immunoperoxidase (Hsu et al., J. Histochem. Cytochem. 29:577-580 (1981)) or cell type(s) (e.g., immunocytochemistry assays).

Albumin fusion proteins can be used to assay levels of polypeptides in a biological sample using classical immunohistological methods known to those of skill in the art (e.g., see Jalkanen, et al., J. Cell. Biol. 101:976-985 (1985); Jalkanen, et al., J. Cell. Biol. 105:3087-3096 (1987)). Other methods useful for detecting protein gene expression include immunoassays, such as the enzyme linked immunosorbent assay (ELISA) and the radioimmunoassay (RIA). Suitable assay labels are known in the art and include enzyme labels, such as, glucose oxidase; radioisotopes, such as iodine ($^{131}I$, $^{125}I$, $^{123}I$, $^{121}I$), carbon ($^{14}C$), sulfur ($^{35}S$), tritium ($^{3}H$), indium ($^{115m}In$, $^{113m}In$, $^{112}In$, $^{111}In$), and technetium ($^{99}Tc$, $^{99m}Tc$), thallium ($^{201}Ti$), gallium ($^{68}Ga$, $^{67}Ga$), palladium ($^{103}Pd$), molybdenum ($^{99}Mo$), xenon ($^{133}Xe$), fluorine ($^{18}F$), $^{153}Sm$, $^{177}Lu$, $^{159}Gd$, $^{149}Pm$, $^{140}La$, $^{175}Yb$, $^{166}Ho$, $^{90}Y$, $^{47}Sc$, $^{186}Re$, $^{188}Re$, $^{142}Pr$, $^{105}Rh$, $^{97}Ru$; luminescent labels, such as luminol; and fluorescent labels, such as fluorescein and rhodamine, and biotin.

Albumin fusion proteins of the invention can also be detected in vivo by imaging. Labels or markers for in vivo imaging of protein include those detectable by X-radiography, nuclear magnetic resonance (NMR) or electron spin relaxation (ESR). For X-radiography, suitable labels include radioisotopes such as barium or cesium, which emit detectable radiation but are not overtly harmful to the subject. Suitable markers for NMR and ESR include those with a detectable characteristic spin, such as deuterium, which may be incorporated into the albumin fusion protein by labeling of nutrients given to a cell line expressing the albumin fusion protein of the invention.

An albumin fusion protein which has been labeled with an appropriate detectable imaging moiety, such as a radioisotope (for example, $^{131}$I, $^{112}$In, $^{99m}$Tc, ($^{131}$I, $^{125}$I, $^{123}$I, $^{121}$I), carbon ($^{14}$C), sulfur ($^{35}$S), tritium ($^{3}$H), indium ($^{115m}$In, $^{113m}$In, $^{112}$In, $^{111}$In), and technetium ($^{99}$Tc, $^{99m}$Tc), thallium ($^{201}$Ti), gallium ($^{68}$Ga, $^{67}$Ga), palladium ($^{103}$Pd), molybdenum ($^{99}$Mo), xenon ($^{133}$Xe), fluorine ($^{18}$F, $^{153}$Sm, $^{177}$Lu, $^{159}$Gd, $^{149}$Pm, $^{140}$La, $^{175}$Yb, $^{166}$Ho, $^{90}$Y, $^{47}$Sc, $^{186}$Re, $^{188}$Re, $^{142}$Pr, $^{105}$Rh, $^{97}$Ru), a radio-opaque substance, or a material detectable by nuclear magnetic resonance, is introduced (for example, parenterally, subcutaneously or intraperitoneally) into the mammal to be examined for immune system disorder. It will be understood in the art that the size of the subject and the imaging system used will determine the quantity of imaging moiety needed to produce diagnostic images. In the case of a radioisotope moiety, for a human subject, the quantity of radioactivity injected will normally range from about 5 to 20 millicuries of $^{99m}$Tc.

The labeled albumin fusion protein will then preferentially accumulate at locations in the body (e.g., organs, cells, extracellular spaces or matrices) where one or more receptors, ligands or substrates (corresponding to that of the Therapeutic protein used to make the albumin fusion protein of the invention) are located. Alternatively, in the case where the albumin fusion protein comprises at least a fragment or variant of a Therapeutic antibody, the labeled albumin fusion protein will then preferentially accumulate at the locations in the body (e.g., organs, cells, extracellular spaces or matrices) where the polypeptides/epitopes corresponding to those bound by the Therapeutic antibody (used to make the albumin fusion protein of the invention) are located. In vivo tumor imaging is described in S. W. Burchiel et al., "Immunopharmacokinetics of Radiolabeled Antibodies and Their Fragments" (Chapter 13 in *Tumor Imaging The Radiochemical Detection of Cancer*, S. W. Burchiel and B. A. Rhodes, eds., Masson Publishing Inc. (1982)). The protocols described therein could easily be modified by one of skill in the art for use with the albumin fusion proteins of the invention.

In one embodiment, the invention provides a method for the specific delivery of albumin fusion proteins of the invention to cells by administering albumin fusion proteins of the invention (e.g., polypeptides encoded by polynucleotides encoding albumin fusion proteins of the invention and/or antibodies) that are associated with heterologous polypeptides or nucleic acids. In one example, the invention provides a method for delivering a Therapeutic protein into the targeted cell. In another example, the invention provides a method for delivering a single stranded nucleic acid (e.g., antisense or ribozymes) or double stranded nucleic acid (e.g., DNA that can integrate into the cell's genome or replicate episomally and that can be transcribed) into the targeted cell.

In another embodiment, the invention provides a method for the specific destruction of cells (e.g., the destruction of tumor cells) by administering albumin fusion proteins of the invention in association with toxins or cytotoxic prodrugs.

By "toxin" is meant one or more compounds that bind and activate endogenous cytotoxic effector systems, radioisotopes, holotoxins, modified toxins, catalytic subunits of toxins, or any molecules or enzymes not normally present in or on the surface of a cell that under defined conditions cause the cell's death. Toxins that may be used according to the methods of the invention include, but are not limited to, radioisotopes known in the art, compounds such as, for example, antibodies (or complement fixing containing portions thereof) that bind an inherent or induced endogenous cytotoxic effector system, thymidine kinase, endonuclease, RNAse, alpha toxin, ricin, abrin, *Pseudomonas* exotoxin A, diphtheria toxin, saporin, momordin, gelonin, pokeweed antiviral protein, alpha-sarcin and cholera toxin. "Toxin" also includes a cytostatic or cytocidal agent, a therapeutic agent or a radioactive metal ion, e.g., alpha-emitters such as, for example, $^{213}$Bi, or other radioisotopes such as, for example, $^{103}$Pd, $^{133}$Xe, $^{131}$I, $^{68}$Ge, $^{57}$Co, $^{65}$Zn, $^{85}$Sr, $^{32}$P, $^{35}$S, $^{90}$Y, $^{153}$Sm, $^{153}$Gd, $^{169}$Yb, $^{51}$Cr, $^{54}$Mn, $^{75}$Se, $^{113}$Sn, $^{90}$Yttrium, $^{117}$Tin, $^{186}$Rhenium, $^{166}$Holmium, and $^{188}$Rhenium; luminescent labels, such as luminol; and fluorescent labels, such as fluorescein and rhodamine, and biotin. In a specific embodiment, the invention provides a method for the specific destruction of cells (e.g., the destruction of tumor cells) by administering polypeptides of the invention or antibodies of the invention in association with the radioisotope $^{90}$Y. In another specific embodiment, the invention provides a method for the specific destruction of cells (e.g., the destruction of tumor cells) by administering polypeptides of the invention or antibodies of the invention in association with the radioisotope $^{111}$In. In a further specific embodiment, the invention provides a method for the specific destruction of cells (e.g., the destruction of tumor cells) by administering polypeptides of the invention or antibodies of the invention in association with the radioisotope $^{131}$I.

Techniques known in the art may be applied to label polypeptides of the invention. Such techniques include, but are not limited to, the use of bifunctional conjugating agents (see e.g., U.S. Pat. Nos. 5,756,065; 5,714,631; 5,696,239; 5,652,361; 5,505,931; 5,489,425; 5,435,990; 5,428,139; 5,342,604; 5,274,119; 4,994,560; and 5,808,003; the contents of each of which are hereby incorporated by reference in its entirety).

The albumin fusion proteins of the present invention are useful for diagnosis, treatment, prevention and/or prognosis of various disorders in mammals, preferably humans. Such disorders include, but are not limited to, those described herein under the section heading "Biological Activities," below.

Thus, the invention provides a diagnostic method of a disorder, which involves (a) assaying the expression level of a certain polypeptide in cells or body fluid of an individual using an albumin fusion protein of the invention; and (b) comparing the assayed polypeptide expression level with a standard polypeptide expression level, whereby an increase or decrease in the assayed polypeptide expression level compared to the standard expression level is indicative of a disorder. With respect to cancer, the presence of a relatively high amount of transcript in biopsied tissue from an individual may indicate a predisposition for the development of the disease, or may provide a means for detecting the disease prior to the appearance of actual clinical symptoms. A more definitive diagnosis of this type may allow health professionals to employ preventative measures or aggressive treatment earlier thereby preventing the development or further progression of the cancer.

Moreover, albumin fusion proteins of the present invention can be used to treat or prevent diseases or conditions such as, for example, neural disorders, immune system disorders, muscular disorders, reproductive disorders, gastrointestinal disorders, pulmonary disorders, cardiovascular disorders, renal disorders, proliferative disorders, and/or cancerous diseases and conditions. For example, patients can be administered a polypeptide of the present invention in an effort to replace absent or decreased levels of the polypeptide (e.g., insulin), to supplement absent or decreased levels of a different polypeptide (e.g., hemoglobin S for hemoglobin B, SOD, catalase, DNA repair proteins), to inhibit the activity of a polypeptide (e.g., an oncogene or tumor suppressor), to activate the activity of a polypeptide (e.g., by binding to a receptor), to reduce the activity of a membrane bound receptor by competing with it for free ligand (e.g., soluble TNF receptors used in reducing inflammation), or to bring about a desired response (e.g., blood vessel growth inhibition, enhancement of the immune response to proliferative cells or tissues).

In particular, albumin fusion proteins comprising of at least a fragment or variant of a Therapeutic antibody can also be used to treat disease (as described supra, and elsewhere herein). For example, administration of an albumin fusion protein comprising of at least a fragment or variant of a Therapeutic antibody can bind, and/or neutralize the polypeptide to which the Therapeutic antibody used to make the albumin fusion protein specifically binds, and/or reduce overproduction of the polypeptide to which the Therapeutic antibody used to make the albumin fusion protein specifically binds. Similarly, administration of an albumin fusion protein comprising of at least a fragment or variant of a Therapeutic antibody can activate the polypeptide to which the Therapeutic antibody used to make the albumin fusion protein specifically binds, by binding to the polypeptide bound to a membrane (receptor).

At the very least, the albumin fusion proteins of the invention of the present invention can be used as molecular weight markers on SDS-PAGE gels or on molecular sieve gel filtration columns using methods well known to those of skill in the art. Albumin fusion proteins of the invention can also be used to raise antibodies, which in turn may be used to measure protein expression of the Therapeutic protein, albumin protein, and/or the albumin fusion protein of the invention from a recombinant cell, as a way of assessing transformation of the host cell, or in a biological sample. Moreover, the albumin fusion proteins of the present invention can be used to test the biological activities described herein.

Diagnostic Assays

The compounds of the present invention are useful for diagnosis, treatment, prevention and/or prognosis of various disorders in mammals, preferably humans. Such disorders include, but are not limited to, those described for each Therapeutic protein in the corresponding row of Table 1 and herein under the section headings "Immune Activity," "Blood Related Disorders," "Hyperproliferative Disorders," "Renal Disorders," "Cardiovascular Disorders," "Respiratory Disorders," "Anti-Angiogenesis Activity," "Diseases at the Cellular Level," "Wound Healing and Epithelial Cell Proliferation," "Neural Activity and Neurological Diseases," "Endocrine Disorders," "Reproductive System Disorders," "Infectious Disease," "Regeneration," and/or "Gastrointestinal Disorders," infra.

For a number of disorders, substantially altered (increased or decreased) levels of gene expression can be detected in tissues, cells or bodily fluids (e.g., sera, plasma, urine, semen, synovial fluid or spinal fluid) taken from an individual having such a disorder, relative to a "standard" gene expression level, that is, the expression level in tissues or bodily fluids from an individual not having the disorder. Thus, the invention provides a diagnostic method useful during diagnosis of a disorder, which involves measuring the expression level of the gene encoding a polypeptide in tissues, cells or body fluid from an individual and comparing the measured gene expression level with a standard gene expression level, whereby an increase or decrease in the gene expression level(s) compared to the standard is indicative of a disorder. These diagnostic assays may be performed in vivo or in vitro, such as, for example, on blood samples, biopsy tissue or autopsy tissue.

The present invention is also useful as a prognostic indicator, whereby patients exhibiting enhanced or depressed gene expression will experience a worse clinical outcome.

By "assaying the expression level of the gene encoding a polypeptide" is intended qualitatively or quantitatively measuring or estimating the level of a particular polypeptide (e.g. a polypeptide corresponding to a Therapeutic protein disclosed in Table 1) or the level of the mRNA encoding the polypeptide of the invention in a first biological sample either directly (e.g., by determining or estimating absolute protein level or mRNA level) or relatively (e.g., by comparing to the polypeptide level or mRNA level in a second biological sample). Preferably, the polypeptide expression level or mRNA level in the first biological sample is measured or estimated and compared to a standard polypeptide level or mRNA level, the standard being taken from a second biological sample obtained from an individual not having the disorder or being determined by averaging levels from a population of individuals not having the disorder. As will be appreciated in the art, once a standard polypeptide level or mRNA level is known, it can be used repeatedly as a standard for comparison.

By "biological sample" is intended any biological sample obtained from an individual, cell line, tissue culture, or other source containing polypeptides of the invention (including portions thereof) or mRNA. As indicated, biological samples include body fluids (such as sera, plasma, urine, synovial fluid and spinal fluid) and tissue sources found to express the full length or fragments thereof of a polypeptide or mRNA. Methods for obtaining tissue biopsies and body fluids from mammals are well known in the art. Where the biological sample is to include mRNA, a tissue biopsy is the preferred source.

Total cellular RNA can be isolated from a biological sample using any suitable technique such as the single-step guanidinium-thiocyanate-phenol-chloroform method described in Chomczynski and Sacchi, Anal. Biochem. 162: 156-159 (1987). Levels of mRNA encoding the polypeptides of the invention are then assayed using any appropriate method. These include Northern blot analysis, S1 nuclease mapping, the polymerase chain reaction (PCR), reverse transcription in combination with the polymerase chain reaction (RT-PCR), and reverse transcription in combination with the ligase chain reaction (RT-LCR).

The present invention also relates to diagnostic assays such as quantitative and diagnostic assays for detecting levels of polypeptides that bind to, are bound by, or associate with albumin fusion proteins of the invention, in a biological sample (e.g., cells and tissues), including determination of normal and abnormal levels of polypeptides. Thus, for instance, a diagnostic assay in accordance with the invention for detecting abnormal expression of polypeptides that bind to, are bound by, or associate with albumin fusion proteins compared to normal control tissue samples may be used to detect the presence of tumors. Assay techniques that can be used to determine levels of a polypeptide that bind to, are bound by, or associate with albumin fusion proteins of the present invention in a sample derived from a host are well-known to those of skill in the art. Such assay methods include radioimmunoassays, competitive-binding assays, Western Blot analysis and ELISA assays. Assaying polypeptide levels in a biological sample can occur using any art-known method.

Assaying polypeptide levels in a biological sample can occur using a variety of techniques. For example, polypeptide expression in tissues can be studied with classical immunohistological methods (Jalkanen et al., J. Cell. Biol. 101:976-

985 (1985); Jalkanen, M., et al., J. Cell. Biol. 105:3087-3096 (1987)). Other methods useful for detecting polypeptide gene expression include immunoassays, such as the enzyme linked immunosorbent assay (ELISA) and the radioimmunoassay (RIA). Suitable antibody assay labels are known in the art and include enzyme labels, such as, glucose oxidase, and radioisotopes, such as iodine ($^{125}$I, $^{121}$I), carbon ($^{14}$C), sulfur ($^{35}$S), tritium ($^{3}$H), indium ($^{112}$In), and technetium ($^{99m}$Tc), and fluorescent labels, such as fluorescein and rhodamine, and biotin.

The tissue or cell type to be analyzed will generally include those which are known, or suspected, to express the gene of interest (such as, for example, cancer). The protein isolation methods employed herein may, for example, be such as those described in Harlow and Lane (Harlow, E. and Lane, D., 1988, "Antibodies: A Laboratory Manual", Cold Spring Harbor Laboratory Press, Cold Spring Harbor, N.Y.), which is incorporated herein by reference in its entirety. The isolated cells can be derived from cell culture or from a patient. The analysis of cells taken from culture may be a necessary step in the assessment of cells that could be used as part of a cell-based gene therapy technique or, alternatively, to test the effect of compounds on the expression of the gene.

For example, albumin fusion proteins may be used to quantitatively or qualitatively detect the presence of polypeptides that bind to, are bound by, or associate with albumin fusion proteins of the present invention. This can be accomplished, for example, by immunofluorescence techniques employing a fluorescently labeled albumin fusion protein coupled with light microscopic, flow cytometric, or fluorimetric detection.

In a preferred embodiment, albumin fusion proteins comprising at least a fragment or variant of an antibody that specifically binds at least a Therapeutic protein disclosed herein (e.g., the Therapeutic proteins disclosed in Table 1) or otherwise known in the art may be used to quantitatively or qualitatively detect the presence of gene products or conserved variants or peptide fragments thereof. This can be accomplished, for example, by immunofluorescence techniques employing a fluorescently labeled antibody coupled with light microscopic, flow cytometric, or fluorimetric detection.

The albumin fusion proteins of the present invention may, additionally, be employed histologically, as in immunofluorescence, immunoelectron microscopy or non-immunological assays, for in situ detection of polypeptides that bind to, are bound by, or associate with an albumin fusion protein of the present invention. In situ detection may be accomplished by removing a histological specimen from a patient, and applying thereto a labeled antibody or polypeptide of the present invention. The albumin fusion proteins are preferably applied by overlaying the labeled albumin fusion proteins onto a biological sample. Through the use of such a procedure, it is possible to determine not only the presence of the polypeptides that bind to, are bound by, or associate with albumin fusion proteins, but also its distribution in the examined tissue. Using the present invention, those of ordinary skill will readily perceive that any of a wide variety of histological methods (such as staining procedures) can be modified in order to achieve such in situ detection.

Immunoassays and non-immunoassays that detect polypeptides that bind to, are bound by, or associate with albumin fusion proteins will typically comprise incubating a sample, such as a biological fluid, a tissue extract, freshly harvested cells, or lysates of cells which have been incubated in cell culture, in the presence of a detectably labeled antibody capable of binding gene products or conserved variants or peptide fragments thereof, and detecting the bound antibody by any of a number of techniques well-known in the art.

The biological sample may be brought in contact with and immobilized onto a solid phase support or carrier such as nitrocellulose, or other solid support which is capable of immobilizing cells, cell particles or soluble proteins. The support may then be washed with suitable buffers followed by treatment with the detectably labeled albumin fusion protein of the invention. The solid phase support may then be washed with the buffer a second time to remove unbound antibody or polypeptide. Optionally the antibody is subsequently labeled. The amount of bound label on solid support may then be detected by conventional means.

By "solid phase support or carrier" is intended any support capable of binding a polypeptide (e.g., an albumin fusion protein, or polypeptide that binds, is bound by, or associates with an albumin fusion protein of the invention.) Well-known supports or carriers include glass, polystyrene, polypropylene, polyethylene, dextran, nylon, amylases, natural and modified celluloses, polyacrylamides, gabbros, and magnetite. The nature of the carrier can be either soluble to some extent or insoluble for the purposes of the present invention. The support material may have virtually any possible structural configuration so long as the coupled molecule is capable of binding to a polypeptide. Thus, the support configuration may be spherical, as in a bead, or cylindrical, as in the inside surface of a test tube, or the external surface of a rod. Alternatively, the surface may be flat such as a sheet, test strip, etc. Preferred supports include polystyrene beads. Those skilled in the art will know many other suitable carriers for binding antibody or antigen, or will be able to ascertain the same by use of routine experimentation.

The binding activity of a given lot of albumin fusion protein may be determined according to well known methods. Those skilled in the art will be able to determine operative and optimal assay conditions for each determination by employing routine experimentation.

In addition to assaying polypeptide levels in a biological sample obtained from an individual, polypeptide can also be detected in vivo by imaging. For example, in one embodiment of the invention, albumin fusion proteins of the invention are used to image diseased or neoplastic cells.

Labels or markers for in vivo imaging of albumin fusion proteins of the invention include those detectable by X-radiography, NMR, MRI, CAT-scans or ESR. For X-radiography, suitable labels include radioisotopes such as barium or cesium, which emit detectable radiation but are not overtly harmful to the subject. Suitable markers for NMR and ESR include those with a detectable characteristic spin, such as deuterium, which may be incorporated into the albumin fusion protein by labeling of nutrients of a cell line (or bacterial or yeast strain) engineered.

Additionally, albumin fusion proteins of the invention whose presence can be detected, can be administered. For example, albumin fusion proteins of the invention labeled with a radio-opaque or other appropriate compound can be administered and visualized in vivo, as discussed, above for labeled antibodies. Further, such polypeptides can be utilized for in vitro diagnostic procedures.

A polypeptide-specific antibody or antibody fragment which has been labeled with an appropriate detectable imaging moiety, such as a radioisotope (for example, $^{131}$I, $^{112}$In, $^{99m}$Tc), a radio-opaque substance, or a material detectable by nuclear magnetic resonance, is introduced (for example, parenterally, subcutaneously or intraperitoneally) into the mammal to be examined for a disorder. It will be understood in the art that the size of the subject and the imaging system used will determine the quantity of imaging moiety needed to produce diagnostic images. In the case of a radioisotope moiety, for a human subject, the quantity of radioactivity injected will normally range from about 5 to 20 millicuries of $^{99m}$Tc. The labeled albumin fusion protein will then preferentially accumulate at the locations in the body which contain a polypeptide or other substance that binds to, is bound by or associates with an albumin fusion protein of the present invention. In vivo tumor imaging is described in S. W. Burchiel et al., "Immunopharmacokinetics of Radiolabeled Antibodies and Their Fragments" (Chapter 13 in *Tumor Imaging: The Radiochemical Detection of Cancer*, S. W. Burchiel and B. A. Rhodes, eds., Masson Publishing Inc. (1982)).

One of the ways in which an albumin fusion protein of the present invention can be detectably labeled is by linking the same to a reporter enzyme and using the linked product in an enzyme immunoassay (EIA) (Voller, A., "The Enzyme Linked Immunosorbent Assay (ELISA)", 1978, Diagnostic Horizons 2:1-7, Microbiological Associates Quarterly Publication, Walkersville, Md.); Voller et al., *J. Clin. Pathol.* 31:507-520 (1978); Butler, J. E., *Meth. Enzymol.* 73:482-523 (1981); Maggio, E. (ed.), 1980, Enzyme Immunoassay, CRC Press, Boca Raton, Fla.; Ishikawa, E. et al., (eds.), 1981, Enzyme Immunoassay, Kgaku Shoin, Tokyo). The reporter enzyme which is bound to the antibody will react with an appropriate substrate, preferably a chromogenic substrate, in such a manner as to produce a chemical moiety which can be detected, for example, by spectrophotometric, fluorimetric or by visual means. Reporter enzymes which can be used to detectably label the antibody include, but are not limited to, malate dehydrogenase, staphylococcal nuclease, delta-5-steroid isomerase, yeast alcohol dehydrogenase, alpha-glycerophosphate, dehydrogenase, triose phosphate isomerase, horseradish peroxidase, alkaline phosphatase, asparaginase, glucose oxidase, beta-galactosidase, ribonuclease, urease, catalase, glucose-6-phosphate dehydrogenase, glucoamylase and acetylcholinesterase. Additionally, the detection can be accomplished by colorimetric methods which employ a chromogenic substrate for the reporter enzyme. Detection may also be accomplished by visual comparison of the extent of enzymatic reaction of a substrate in comparison with similarly prepared standards.

Albumin fusion proteins may also be radiolabelled and used in any of a variety of other immunoassays. For example, by radioactively labeling the albumin fusion proteins, it is possible to the use the albumin fusion proteins in a radioimmunoassay (RIA) (see, for example, Weintraub, B., Principles of Radioimmunoassays, Seventh Training Course on Radioligand Assay Techniques, The Endocrine Society, March, 1986, which is incorporated by reference herein). The radioactive isotope can be detected by means including, but not limited to, a gamma counter, a scintillation counter, or autoradiography.

Additionally, chelator molecules, are known in the art and can be used to label the Albumin fusion proteins. Chelator molecules may be attached Albumin fusion proteins of the invention to facilitate labeling said protein with metal ions including radionuclides or fluorescent labels. For example, see Subramanian, R. and Meares, C. F., "Bifunctional Chelating Agents for Radiometal-labeled monoclonal Antibodies," in *Cancer Imaging with Radiolabeled Antibodies* (D. M. Goldenberg, Ed.) Kluwer Academic Publications, Boston; Saji, H., "Targeted delivery of radiolabeled imaging and therapeutic agents: bifunctional radiopharmaceuticals." *Crit. Rev. Ther. Drug Carrier Syst.* 16:209-244 (1999); Srivastava S. C. and Mease R. C., "Progress in research on ligands, nuclides and techniques for labeling monoclonal antibodies." *Int. J. Rad. Appl. Instrum. B* 18:589-603 (1991); and Liu, S, and Edwards, D. S., "Bifunctional chelators for therapeutic lanthanide radiopharmaceuticals." *Bioconjug. Chem.* 12:7-34 (2001). Any chelator which can be covalently bound to said Albumin fusion proteins may be used according to the present invention. The chelator may further comprise a linker moiety that connects the chelating moiety to the Albumin fusion protein.

In one embodiment, the Albumin fusion protein of the invention are attached to an acyclic chelator such as diethylene triamine-N,N,N',N",N"-pentaacetic acid (DPTA), analogues of DPTA, and derivatives of DPTA. As non-limiting examples, the chelator may be 2-(p-isothiocyanatobenzyl)-6-methyldiethylenetriaminepentaacetic acid (1B4M-DPTA, also known as MX-DTPA), 2-methyl-6-(rho-nitrobenzyl)-1,4,7-triazaheptane-N,N,N',N",N"-pentaacetic acid (nitro-1B4M-DTPA or nitro-MX-DTPA); 2-(p-isothiocyanatobenzyl)-cyclohexyldiethylenetriaminepentaacetic acid (CHX-DTPA), or N-[2-amino-3-(rho-nitrophenyl)propyl]-trans-cyclohexane-1,2-diamine-N,N',N"-pentaacetic acid (nitro-CHX-A-DTPA).

In another embodiment, the Albumin fusion protein of the invention are attached to an acyclic terpyridine chelator such as 6,6"-bis[[N,N,N",N"-tetra(carboxymethyl)amino]methyl]-4'-(3-amino-4-methoxyphenyl)-2,2':6',2 terpyridine (TMT-amine).

In specific embodiments, the macrocyclic chelator which is attached to the Albumin fusion protein of the invention is 1,4,7,10-tetraazacyclododecane-N,N',N",N'"-tetraacetic acid (DOTA). In other specific embodiments, the DOTA is attached to the Albumin fusion protein of the invention via a linker molecule. Examples of linker molecules useful for conjugating DOTA to a polypeptide are commonly known in the art—see, for example, DeNardo et al., *Clin. Cancer Res.* 4(10):2483-90, 1998; Peterson et al., *Bioconjug. Chem.* 10(4):553-7, 1999; and Zimmerman et al., *Nucl. Med. Biol.* 26(8):943-50, 1999 which are hereby incorporated by reference in their entirety. In addition, U.S. Pat. Nos. 5,652,361 and 5,756,065, which disclose chelating agents that may be conjugated to antibodies, and methods for making and using them, are hereby incorporated by reference in their entireties. Though U.S. Pat. Nos. 5,652,361 and 5,756,065 focus on conjugating chelating agents to antibodies, one skilled in the art could readily adapt the method disclosed therein in order to conjugate chelating agents to other polypeptides.

Bifunctional chelators based on macrocyclic ligands in which conjugation is via an activated arm, or functional group, attached to the carbon backbone of the ligand can be employed as described by M. Moi et al., *J. Amer. Chem. Soc.* 49:2639 (1989) (2-p-nitrobenzyl-1,4,7,10-tetraazacyclododecane-N,N',N",N'"-tetraacetic acid); S. V. Deshpande et al., *J. Nucl. Med.* 31:473 (1990); G. Ruser et al., *Bioconj. Chem.* 1:345 (1990); C. J. Broan et al., *J. C. S. Chem. Comm.* 23:1739 (1990); and C. J. Anderson et al., *J. Nucl. Med.* 36:850 (1995).

In one embodiment, a macrocyclic chelator, such as polyazamacrocyclic chelators, optionally containing one or more carboxy, amino, hydroxamate, phosphonate, or phosphate groups, are attached to the Albumin fusion protein of the invention. In another embodiment, the chelator is a chelator selected from the group consisting of DOTA, analogues of DOTA, and derivatives of DOTA.

In one embodiment, suitable chelator molecules that may be attached to the Albumin fusion protein of the invention include DOXA (1-oxa-4,7,10-triazacyclododecanetriacetic acid), NOTA (1,4,7-triazacyclononanetriacetic acid), TETA (1,4,8,11-tetraazacyclotetradecanetetraacetic acid), and THT (4'-(3-amino-4-methoxy-phenyl)-6,6"-bis(N',N'-dicarboxymethyl-N-methylhydrazino)-2,2':6',2"-terpyridine), and analogs and derivatives thereof. See, e.g., Ohmono et al., *J. Med. Chem.* 35: 157-162 (1992); Kung et al., *J. Nucl. Med.* 25: 326-332 (1984); Jurisson et al., *Chem. Rev.* 93:1137-1156 (1993); and U.S. Pat. No. 5,367,080. Other suitable chelators include chelating agents disclosed in U.S. Pat. Nos. 4,647,447; 4,687,659; 4,885,363; EP-A-71564; WO89/00557; and EP-A-232751.

In another embodiment, suitable macrocyclic carboxylic acid chelators which can be used in the present invention include 1,4,7,10-tetraazacyclododecane-N,N',N",N'"-tetraacetic acid (DOTA); 1,4,8,12-tetraazacyclopentadecane-N,N',N",N'"-tetraacetic acid (15N4); 1,4,7-triazacyclononane-N,N',N"-triacetic acid (9N3); 1,5,9-triazacyclododecane-N,N',N"-triacetic acid (12N3); and 6-bromoacetamido-benzyl-1,4,8,11-tetraazacyclotetradecane-N,N',N",N'"-tetraacetic acid (BAT).

A preferred chelator that can be attached to the Albumin Fusion protein of the invention is α-(5-isothiocyanato-2-methoxyphenyl)-1,4,7,10-tetraazacyclododecane-1,4,7,10-tetraacetic acid, which is also known as MeO-DOTA-NCS. A salt or ester of α-(5-isothiocyanato-2-methoxyphenyl)-1,4,7,10-tetraazacyclododecane-1,4,7,10-tetraacetic acid may also be used.

Albumin fusion proteins of the invention to which chelators such as those described are covalently attached may be labeled (via the coordination site of the chelator) with radionuclides that are suitable for therapeutic, diagnostic, or both therapeutic and diagnostic purposes. Examples of appropriate metals include Ag, At, Au, Bi, Cu, Ga, Ho, In, Lu, Pb, Pd, Pm, Pr, Rb, Re, Rh, Sc, Sr, Tc, Tl, Y, and Yb. Examples of the radionuclide used for diagnostic purposes are Fe, Gd, $^{111}$In, $^{67}$Ga, or $^{68}$Ga. In another embodiment, the radionuclide used for diagnostic purposes is $^{111}$In, or $^{67}$Ga. Examples of the radionuclide used for therapeutic purposes are $^{166}$Ho, $^{165}$Dy, $^{90}$Y, $^{115m}$In, $^{52}$Fe, or $^{72}$Ga. In one embodiment, the radionuclide used for diagnostic purposes is $^{166}$Ho or $^{90}$Y. Examples of the radionuclides used for both therapeutic and diagnostic purposes include $^{153}$Sm, $^{177}$Lu, $^{159}$Gd, $^{175}$Yb, or $^{47}$Sc. In one embodiment, the radionuclide is $^{153}$Sm, $^{177}$Lu, $^{175}$Yb, or $^{159}$Gd.

Preferred metal radionuclides include $^{90}$Y, $^{99m}$Tc, $^{111}$In, $^{47}$Sc, $^{67}$Ga, $^{51}$Cr, $^{177m}$Sn, $^{67}$Cu, $^{167}$Tm, $^{97}$Ru, $^{188}$Re, $^{177}$Lu, $^{199}$Au, $^{47}$Sc, $^{67}$Ga, $^{51}$Cr, $^{177m}$Sn, $^{67}$Cu, $^{167}$Tm, $^{95}$Ru, $^{188}$Re, $^{177}$Lu, $^{199}$Au, $^{203}$Pb and $^{141}$Ce.

In a particular embodiment, Albumin fusion proteins of the invention to which chelators are covalently attached may be labeled with a metal ion selected from the group consisting of $^{90}$Y, $^{111}$In, $^{177}$Lu, $^{166}$Ho, $^{215}$Bi, and $^{225}$Ac.

Moreover, γ-emitting radionuclides, such as $^{99m}$Tc, $^{111}$In, $^{67}$Ga, and $^{169}$Yb have been approved or under investigation for diagnostic imaging, while β-emitters, such as $^{67}$Cu, $^{111}$Ag, $^{186}$Re, and $^{90}$Y are useful for the applications in tumor therapy. Also other useful radionuclides include γ-emitters, such as $^{99m}$Tc, $^{111}$In, $^{67}$Ga, and $^{169}$Yb, and β-emitters, such as $^{67}$Cu, $^{111}$Ag, $^{186}$Re, $^{188}$Re and $^{90}$Y, as well as other radionuclides of interest such as $^{211}$At, $^{212}$Bi, $^{177}$Lu, $^{86}$Rb, $^{105}$Rh, $^{153}$Sm, $^{198}$Au, $^{149}$Pm, $^{5}$Sr, $^{142}$Pr, $^{214}$Pb, $^{109}$Pd, $^{166}$Ho, $^{208}$Tl, and $^{44}$Sc. Albumin fusion proteins of the invention to which chelators are covalently attached may be labeled with the radionuclides described above.

In another embodiment, Albumin fusion proteins of the invention to which chelators are covalently attached may be labeled with paramagnetic metal ions including ions of transition and lanthanide metal, such as metals having atomic numbers of 21-29, 42, 43, 44, or 57-71, in particular ions of Cr, V, Mn, Fe, Co, Ni, Cu, La, Ce, Pr, Nd, Pm, Sm, Eu, Gd, Tb, Dy, Ho, Er, Tm, Yb, and Lu. The paramagnetic metals used in compositions for magnetic resonance imaging include the elements having atomic numbers of 22 to 29, 42, 44 and 58-70.

In another embodiment, Albumin fusion proteins of the invention to which chelators are covalently attached may be labeled with fluorescent metal ions including lanthanides, in particular La, Ce, Pr, Nd, Pm, Sm, Eu (e.g., $^{152}$Eu), Gd, Tb, Dy, Ho, Er, Tm, Yb, and Lu.

In another embodiment, Albumin fusion proteins of the invention to which chelators are covalently attached may be labeled with heavy metal-containing reporters may include atoms of Mo, Bi, Si, and W.

It is also possible to label the albumin fusion proteins with a fluorescent compound. When the fluorescently labeled antibody is exposed to light of the proper wave length, its presence can then be detected due to fluorescence. Among the most commonly used fluorescent labeling compounds are fluorescein isothiocyanate, rhodamine, phycoerythrin, phycocyanin, allophycocyanin, ophthaldehyde and fluorescamine.

The albumin fusion protein can also be detectably labeled using fluorescence emitting metals such as $^{152}$Eu, or others of the lanthanide series. These metals can be attached to the antibody using such metal chelating groups as diethylenetriaminepentacetic acid (DTPA) or ethylenediaminetetraacetic acid (EDTA).

The albumin fusion proteins can also can be detectably labeled by coupling it to a chemiluminescent compound. The presence of the chemiluminescent-tagged albumin fusion protein is then determined by detecting the presence of luminescence that arises during the course of a chemical reaction. Examples of particularly useful chemiluminescent labeling compounds are luminol, isoluminol, theromatic acridinium ester, imidazole, acridinium salt and oxalate ester.

Likewise, a bioluminescent compound may be used to label albumin fusion proteins of the present invention. Bioluminescence is a type of chemiluminescence found in biological systems in, which a catalytic protein increases the efficiency of the chemiluminescent reaction. The presence of a bioluminescent protein is determined by detecting the presence of luminescence. Important bioluminescent compounds for purposes of labeling are luciferin, luciferase and aequorin.

Transgenic Organisms

Transgenic organisms that express the albumin fusion proteins of the invention are also included in the invention. Transgenic organisms are genetically modified organisms into which recombinant, exogenous or cloned genetic material has been transferred. Such genetic material is often referred to as a transgene. The nucleic acid sequence of the transgene may include one or more transcriptional regulatory sequences and other nucleic acid sequences such as introns, that may be necessary for optimal expression and secretion of the encoded protein. The transgene may be designed to direct the expression of the encoded protein in a manner that facilitates its recovery from the organism or from a product produced by the organism, e.g. from the milk, blood, urine, eggs, hair or seeds of the organism. The transgene may consist of nucleic acid sequences derived from the genome of the same species or of a different species than the species of the target animal. The transgene may be integrated either at a locus of a genome where that particular nucleic acid sequence is not otherwise normally found or at the normal locus for the transgene.

The term "germ cell line transgenic organism" refers to a transgenic organism in which the genetic alteration or genetic information was introduced into a germ line cell, thereby conferring the ability of the transgenic organism to transfer the genetic information to offspring. If such offspring in fact possess some or all of that alteration or genetic information, then they too are transgenic organisms. The alteration or genetic information may be foreign to the species of organism to which the recipient belongs, foreign only to the particular individual recipient, or may be genetic information already possessed by the recipient. In the last case, the altered or introduced gene may be expressed differently than the native gene.

A transgenic organism may be a transgenic animal or a transgenic plant. Transgenic animals can be produced by a variety of different methods including transfection, electroporation, microinjection, gene targeting in embryonic stem cells and recombinant viral and retroviral infection (see, e.g., U.S. Pat. No. 4,736,866; U.S. Pat. No. 5,602,307; Mullins et al. (1993) Hypertension 22(4):630-633; Brenin et al. (1997) Surg. Oncol. 6(2)99-110; Tuan (ed.), *Recombinant Gene Expression Protocols*, Methods in Molecular Biology No. 62, Humana Press (1997)). The method of introduction of nucleic acid fragments into recombination competent mammalian cells can be by any method which favors co-transformation of multiple nucleic acid molecules. Detailed procedures for producing transgenic animals are readily available to one skilled in the art, including the disclosures in U.S. Pat. No. 5,489,743 and U.S. Pat. No. 5,602,307.

A number of recombinant or transgenic mice have been produced, including those which express an activated oncogene sequence (U.S. Pat. No. 4,736,866); express simian SV40 T-antigen (U.S. Pat. No. 5,728,915); lack the expression of interferon regulatory factor 1 (IRF-1) (U.S. Pat. No. 5,731,490); exhibit dopaminergic dysfunction (U.S. Pat. No. 5,723,719); express at least one human gene which participates in blood pressure control (U.S. Pat. No. 5,731,489); display greater similarity to the conditions existing in naturally occurring Alzheimer's disease (U.S. Pat. No. 5,720,936); have a reduced capacity to mediate cellular adhesion (U.S. Pat. No. 5,602,307); possess a bovine growth hormone gene (Clutter et al. (1996) Genetics 143(4):1753-1760); or, are capable of generating a fully human antibody response (McCarthy (1997) The Lancet 349(9049):405).

While mice and rats remain the animals of choice for most transgenic experimentation, in some instances it is preferable or even necessary to use alternative animal species. Transgenic procedures have been successfully utilized in a variety of non-murine animals, including sheep, goats, pigs, dogs, cats, monkeys, chimpanzees, hamsters, rabbits, cows and guinea pigs (see, e.g., Kim et al. (1997) Mol. Reprod. Dev. 46(4):515-526; Houdebine (1995) Reprod. Nutr. Dev. 35(6): 609-617; Petters (1994) Reprod. Fertil. Dev. 6(5):643-645; Schnieke et al. (1997) Science 278(5346):2130-2133; and Amoah (1997) J. Animal Science 75(2):578-585).

To direct the secretion of the transgene-encoded protein of the invention into the milk of transgenic mammals, it may be put under the control of a promoter that is preferentially activated in mammary epithelial cells. Promoters that control the genes encoding milk proteins are preferred, for example the promoter for casein, beta lactoglobulin, whey acid protein, or lactalbumin (see, e.g., DiTullio (1992) BioTechnology 10:74-77; Clark et al. (1989) BioTechnology 7:487-492; Gorton et al. (1987) BioTechnology 5:1183-1187; and Soulier et al. (1992) FEBS Letts. 297:13). The transgenic mammals of choice would produce large volumes of milk and have long lactating periods, for example goats, cows, camels or sheep.

An albumin fusion protein of the invention can also be expressed in a transgenic plant, e.g. a plant in which the DNA transgene is inserted into the nuclear or plastidic genome. Plant transformation procedures used to introduce foreign nucleic acids into plant cells or protoplasts are known in the art. See, in general, Methods in Enzymology Vol. 153 ("Recombinant DNA Part D") 1987, Wu and Grossman Eds., Academic Press and European Patent Application EP 693554. Methods for generation of genetically engineered plants are further described in U.S. Pat. No. 5,283,184, U.S. Pat. No. 5,482,852, and European Patent Application EP 693 554, all of which are hereby incorporated by reference.

Pharmaceutical or Therapeutic Compositions

The albumin fusion proteins of the invention or formulations thereof may be administered by any conventional method including parenteral (e.g. subcutaneous or intramuscular) injection or intravenous infusion. The treatment may consist of a single dose or a plurality of doses over a period of time.

While it is possible for an albumin fusion protein of the invention to be administered alone, it is preferable to present it as a pharmaceutical formulation, together with one or more acceptable carriers. The carrier(s) must be "acceptable" in the sense of being compatible with the albumin fusion protein and not deleterious to the recipients thereof. Typically, the carriers will be water or saline which will be sterile and pyrogen free. Albumin fusion proteins of the invention are particularly well suited to formulation in aqueous carriers such as sterile pyrogen free water, saline or other isotonic solutions because of their extended shelf-life in solution. For instance, pharmaceutical compositions of the invention may be formulated well in advance in aqueous form, for instance, weeks or months or longer time periods before being dispensed.

For example, formulations containing the albumin fusion protein may be prepared taking into account the extended shelf-life of the albumin fusion protein in aqueous formulations. As discussed above, the shelf-life of many of these Therapeutic proteins are markedly increased or prolonged after fusion to HA.

In instances where aerosol administration is appropriate, the albumin fusion proteins of the invention can be formulated as aerosols using standard procedures. The term "aerosol" includes any gas-borne suspended phase of an albumin fusion protein of the instant invention which is capable of being inhaled into the bronchioles or nasal passages. Specifically, aerosol includes a gas-borne suspension of droplets of an albumin fusion protein of the instant invention, as may be produced in a metered dose inhaler or nebulizer, or in a mist sprayer. Aerosol also includes a dry powder composition of a compound of the instant invention suspended in air or other carrier gas, which may be delivered by insufflation from an inhaler device, for example. See Ganderton & Jones, *Drug Delivery to the Respiratory Tract*, Ellis Horwood (1987); Gonda (1990) *Critical Reviews in Therapeutic Drug Carrier Systems* 6:273-313; and Raeburn et al., (1992) *Pharmacol. Toxicol. Methods* 27:143-159.

The formulations of the invention are also typically non-immunogenic, in part, because of the use of the components of the albumin fusion protein being derived from the proper species. For instance, for human use, both the Therapeutic protein and albumin portions of the albumin fusion protein will typically be human. In some cases, wherein either component is non human-derived, that component may be humanized by substitution of key amino acids so that specific epitopes appear to the human immune system to be human in nature rather than foreign.

The formulations may conveniently be presented in unit dosage form and may be prepared by any of the methods well known in the art of pharmacy. Such methods include the step of bringing into association the albumin fusion protein with the carrier that constitutes one or more accessory ingredients. In general the formulations are prepared by uniformly and intimately bringing into association the active ingredient with liquid carriers or finely divided solid carriers or both, and then, if necessary, shaping the product.

Formulations suitable for parenteral administration include aqueous and non-aqueous sterile injection solutions which may contain anti-oxidants, buffers, bacteriostats and solutes which render the formulation appropriate for the intended recipient; and aqueous and non-aqueous sterile suspensions which may include suspending agents and thickening agents. The formulations may be presented in unit-dose or multi-dose containers, for example sealed ampules, vials or syringes, and may be stored in a freeze-dried (lyophilised) condition requiring only the addition of the sterile liquid carrier, for example water for injections, immediately prior to use. Extemporaneous injection solutions and suspensions may be prepared from sterile powders. Dosage formulations may contain the Therapeutic protein portion at a lower molar concentration or lower dosage compared to the non-fused standard formulation for the Therapeutic protein given the extended serum half-life exhibited by many of the albumin fusion proteins of the invention.

As an example, when an albumin fusion protein of the invention comprises one of the proteins listed in the "Therapeutic Protein:X" column of Table 1 as one or more of the Therapeutic protein regions, the dosage form can be calculated on the basis of the potency of the albumin fusion protein relative to the potency of the therapeutic protein alone, while taking into account the prolonged serum half-life and shelf-life of the albumin fusion proteins compared to that of native therapeutic protein. For example, if the therapeutic protein is typically administered at 0.3 to 30.0 IU/kg/week, or 0.9 to 12.0 IU/kg/week, given in three or seven divided doses for a year or more. In an albumin fusion protein consisting of full length HA fused to a therapeutic protein, an equivalent dose in terms of units would represent a greater weight of agent but the dosage frequency can be reduced, for example to twice a week, once a week or less.

Formulations or compositions of the invention may be packaged together with, or included in a kit with, instructions or a package insert referring to the extended shelf-life of the albumin fusion protein component. For instance, such instructions or package inserts may address recommended storage conditions, such as time, temperature and light, taking into account the extended or prolonged shelf-life of the albumin fusion proteins of the invention. Such instructions or package inserts may also address the particular advantages of the albumin fusion proteins of the inventions, such as the ease of storage for formulations that may require use in the field, outside of controlled hospital, clinic or office conditions. As described above, formulations of the invention may be in aqueous form and may be stored under less than ideal circumstances without significant loss of therapeutic activity.

Albumin fusion proteins of the invention can also be included in nutraceuticals. For instance, certain albumin fusion proteins of the invention may be administered in natural products, including milk or milk product obtained from a transgenic mammal which expresses albumin fusion protein. Such compositions can also include plant or plant products obtained from a transgenic plant which expresses the albumin fusion protein. The albumin fusion protein can also be provided in powder or tablet form, with or without other known additives, carriers, fillers and diluents. Nutraceuticals are described in Scott Hegenhart, *Food Product Design*, December 1993.

The invention also provides methods of treatment and/or prevention of diseases or disorders (such as, for example, any one or more of the diseases or disorders disclosed herein) by administration to a subject of an effective amount of an albumin fusion protein of the invention or a polynucleotide encoding an albumin fusion protein of the invention ("albumin fusion polynucleotide") in a pharmaceutically acceptable carrier.

The albumin fusion protein and/or polynucleotide will be formulated and dosed in a fashion consistent with good medical practice, taking into account the clinical condition of the individual patient (especially the side effects of treatment with the albumin fusion protein and/or polynucleotide alone), the site of delivery, the method of administration, the scheduling of administration, and other factors known to practitioners. The "effective amount" for purposes herein is thus determined by such considerations.

As a general proposition, the total pharmaceutically effective amount of the albumin fusion protein administered parenterally per dose will be in the range of about 1 ug/kg/day to 10 mg/kg/day of patient body weight, although, as noted above, this will be subject to therapeutic discretion. More preferably, this dose is at least 0.01 mg/kg/day, and most preferably for humans between about 0.01 and 1 mg/kg/day for the hormone. If given continuously, the albumin fusion protein is typically administered at a dose rate of about 1 ug/kg/hour to about 50 ug/kg/hour, either by 1-4 injections per day or by continuous subcutaneous infusions, for example, using a mini-pump. An intravenous bag solution may also be employed. The length of treatment needed to observe changes and the interval following treatment for responses to occur appears to vary depending on the desired effect.

As noted above, the albumin fusion protein of the invention has a higher plasma stablity compared to the Therapeutic protein portion (or fragment or variant thereof) alone. This increase in plasma stability should be taken into account when determining the effective amount of the albumin fusion protein to be administered per dose and the dosing administration schedule. In particular, higher plasma stability may allow the albumin fusion protein to be administered at a lower dose at the same frequency of administrations, or alternatively, may allow the albumin fusion protein to be administered in fewer dosings. Preferably, the higher stability allows the albumin fusion protein of the invention to be administered less often in fewer dosings. More preferably, the albumin fusion protein can be administered once every two weeks. Still more preferably, the albumin fusion protein can be administered once every three, four, five, or more weeks depending on the pharmacokinetics of the albumin fusion protein.

The effective amount of the albumin fusion protein to be administered per dose can also be denoted as the total formulated albumin fusion protein concentration given per dose. In one embodiment, the total formulated albumin fusion protein concentration administered to a patient per dose is in the range of about 10 ug/dose to about 2000 ug/dose. More preferably, the total concentration is in the range of about 100 ug/dose to about 1000 ug/dose, or alternatively, about 1000 ug/dose to about 1200 ug/dose or about 900 ug/dose to about 1800 ug/dose.

The total formulated concentration of the albumin fusion protein and the dosing interval in which the dosing interval at which the albumin fusion protein will administered will vary depending on the desired effect and the particular therapeutic protein adminstered. In one embodiment, the total formulated albumin fusion protein concentration administered to a patient per dose is in the range of about 10 ug/dose to about 2000 ug/dose once a week, once every two weeks, once every three weeks, once every four weeks or more. More preferably, the total concentration is in the range of about 100 ug/dose to about 1000 ug/dose once a week, once every two weeks, once every three weeks, once every four weeks or more, or alternatively, about 1000 ug/dose to about 1200 ug/dose or about 900 ug/dose to about 1800 ug/dose once a week, once every two weeks, once every three weeks, once every four weeks or more.

Albumin fusion proteins and/or polynucleotides can be are administered orally, rectally, parenterally, intracisternally, intravaginally, intraperitoneally, topically (as by powders, ointments, gels, drops or transdermal patch), bucally, or as an oral or nasal spray. “Pharmaceutically acceptable carrier” refers to a non-toxic solid, semisolid or liquid filler, diluent, encapsulating material or formulation auxiliary of any. The term “parenteral” as used herein refers to modes of administration which include intravenous, intramuscular, intraperitoneal, intrasternal, subcutaneous and intraarticular injection and infusion.

Albumin fusion proteins and/or polynucleotides of the invention are also suitably administered by sustained-release systems. Examples of sustained-release albumin fusion proteins and/or polynucleotides are administered orally, rectally, parenterally, intracisternally, intravaginally, intraperitoneally, topically (as by powders, ointments, gels, drops or transdermal patch), bucally, or as an oral or nasal spray. “Pharmaceutically acceptable carrier” refers to a non-toxic solid, semisolid or liquid filler, diluent, encapsulating material or formulation auxiliary of any type. The term “parenteral” as used herein refers to modes of administration which include intravenous, intramuscular, intraperitoneal, intrasternal, subcutaneous and intraarticular injection and infusion. Additional examples of sustained-release albumin fusion proteins and/or polynucleotides include suitable polymeric materials (such as, for example, semi-permeable polymer matrices in the form of shaped articles, e.g., films, or mirocapsules), suitable hydrophobic materials (for example as an emulsion in an acceptable oil) or ion exchange resins, and sparingly soluble derivatives (such as, for example, a sparingly soluble salt).

Sustained-release matrices include polylactides (U.S. Pat. No. 3,773,919, EP 58,481), copolymers of L-glutamic acid and gamma-ethyl-L-glutamate (Sidman et al., Biopolymers 22:547-556 (1983)), poly (2-hydroxyethyl methacrylate) (Langer et al., J. Biomed. Mater. Res. 15:167-277 (1981), and Langer, Chem. Tech. 12:98-105 (1982)), ethylene vinyl acetate (Langer et al., Id.) or poly-D-(−)-3-hydroxybutyric acid (EP 133,988).

Sustained-release albumin fusion proteins and/or polynucleotides also include liposomally entrapped albumin fusion proteins and/or polynucleotides of the invention (see generally, Langer, *Science* 249:1527-1533 (1990); Treat et al., in *Liposomes in the Therapy of Infectious Disease and Cancer*, Lopez-Berestein and Fidler (eds.), Liss, New York, pp. 317-327 and 353-365 (1989)). Liposomes containing the albumin fusion protein and/or polynucleotide are prepared by methods known per se: DE 3,218,121; Epstein et al., Proc. Natl. Acad. Sci. (USA) 82:3688-3692 (1985); Hwang et al., Proc. Natl. Acad. Sci. (USA) 77:4030-4034 (1980); EP 52,322; EP 36,676; EP 88,046; EP 143,949; EP 142,641; Japanese Pat. Appl. 83-118008; U.S. Pat. Nos. 4,485,045 and 4,544,545; and EP 102,324. Ordinarily, the liposomes are of the small (about 200-800 Angstroms) unilamellar type in which the lipid content is greater than about 30 mol. percent cholesterol, the selected proportion being adjusted for the optimal Therapeutic.

In yet an additional embodiment, the albumin fusion proteins and/or polynucleotides of the invention are delivered by way of a pump (see Langer, supra; Sefton, CRC Crit. Ref. Biomed. Eng. 14:201 (1987); Buchwald et al., Surgery 88:507 (1980); Saudek et al., N. Engl. J. Med. 321:574 (1989)).

Other controlled release systems are discussed in the review by Langer (Science 249:1527-1533 (1990)).

For parenteral administration, in one embodiment, the albumin fusion protein and/or polynucleotide is formulated generally by mixing it at the desired degree of purity, in a unit dosage injectable form (solution, suspension, or emulsion), with a pharmaceutically acceptable carrier, i.e., one that is non-toxic to recipients at the dosages and concentrations employed and is compatible with other ingredients of the formulation. For example, the formulation preferably does not include oxidizing agents and other compounds that are known to be deleterious to the Therapeutic.

Generally, the formulations are prepared by contacting the albumin fusion protein and/or polynucleotide uniformly and intimately with liquid carriers or finely divided solid carriers or both. Then, if necessary, the product is shaped into the desired formulation. Preferably the carrier is a parenteral carrier, more preferably a solution that is isotonic with the blood of the recipient. Examples of such carrier vehicles include water, saline, Ringer's solution, and dextrose solution. Non-aqueous vehicles such as fixed oils and ethyl oleate are also useful herein, as well as liposomes.

The carrier suitably contains minor amounts of additives such as substances that enhance isotonicity and chemical stability. Such materials are non-toxic to recipients at the dosages and concentrations employed, and include buffers such as phosphate, citrate, succinate, acetic acid, and other organic acids or their salts; antioxidants such as ascorbic acid; low molecular weight (less than about ten residues) polypeptides, e.g., polyarginine or tripeptides; proteins, such as serum albumin, gelatin, or immunoglobulins; hydrophilic polymers such as polyvinylpyrrolidone; amino acids, such as glycine, glutamic acid, aspartic acid, or arginine; monosaccharides, disaccharides, and other carbohydrates including cellulose or its derivatives, glucose, manose, or dextrins; chelating agents such as EDTA; sugar alcohols such as mannitol or sorbitol; counterions such as sodium; and/or nonionic surfactants such as polysorbates (including, for example, Tween-20), poloxamers, or PEG.

The albumin fusion protein is typically formulated in such vehicles at a concentration of about 0.1 mg/ml to 100 mg/ml, preferably 1-10 mg/ml, at a pH of about 3 to 8. It will be understood that the use of certain of the foregoing excipients, carriers, or stabilizers will result in the formation of polypeptide salts.

Any pharmaceutical used for therapeutic administration can be sterile. Sterility is readily accomplished by filtration through sterile filtration membranes (e.g., 0.2 micron membranes). Albumin fusion proteins and/or polynucleotides generally are placed into a container having a sterile access port, for example, an intravenous solution bag or vial having a stopper pierceable by a hypodermic injection needle.

Albumin fusion proteins and/or polynucleotides ordinarily will be stored in unit or multi-dose containers, for example, sealed ampoules or vials, as an aqueous solution or as a lyophilized formulation for reconstitution. As an example of a lyophilized formulation, 10-ml vials are filled with 5 ml of sterile-filtered 1% (w/v) aqueous albumin fusion protein and/or polynucleotide solution, and the resulting mixture is lyophilized. The infusion solution is prepared by reconstituting the lyophilized albumin fusion protein and/or polynucleotide using bacteriostatic Water-for-Injection.

In a specific and preferred embodiment, the Albumin fusion protein formulations comprises 0.01 M sodium phosphate, 0.15 mM sodium chloride, 0.16 micromole sodium octanoate/milligram of fusion protein, 15 micrograms/milliliter polysorbate 80, pH 7.2. In another specific and preferred embodiment, the Albumin fusion protein formulations consists 0.01 M sodium phosphate, 0.15 mM sodium chloride, 0.16 micromole sodium octanoate/milligram of fusion protein, 15 micrograms/milliliter polysorbate 80, pH 7.2. The pH and buffer are chosen to match physiological conditions and the salt is added as a tonicifier. Sodium octanoate has been chosen due to its reported ability to increase the thermal stability of the protein in solution. Finally, polysorbate has been added as a generic surfactant, which lowers the surface tension of the solution and lowers non-specific adsorption of the albumin fusion protein to the container closure system.

The invention also provides a pharmaceutical pack or kit comprising one or more containers filled with one or more of the ingredients of the albumin fusion proteins and/or polynucleotides of the invention. Associated with such container(s) can be a notice in the form prescribed by a governmental agency regulating the manufacture, use or sale of pharmaceuticals or biological products, which notice reflects approval by the agency of manufacture, use or sale for human administration. In addition, the albumin fusion proteins and/or polynucleotides may be employed in conjunction with other therapeutic compounds.

The albumin fusion proteins and/or polynucleotides of the invention may be administered alone or in combination with adjuvants. Adjuvants that may be administered with the albumin fusion proteins and/or polynucleotides of the invention include, but are not limited to, alum, alum plus deoxycholate (ImmunoAg), MTP-PE (Biocine Corp.), QS21 (Genentech, Inc.), BCG (e.g., THERACYS®), MPL and nonviable preparations of *Corynebacterium parvum*. In a specific embodiment, albumin fusion proteins and/or polynucleotides of the invention are administered in combination with alum. In another specific embodiment, albumin fusion proteins and/or polynucleotides of the invention are administered in combination with QS-21. Further adjuvants that may be administered with the albumin fusion proteins and/or polynucleotides of the invention include, but are not limited to, Monophosphoryl lipid immunomodulator, AdjuVax 100a, QS-21, QS-18, CRL1005, Aluminum salts, MF-59, and Virosomal adjuvant technology. Vaccines that may be administered with the albumin fusion proteins and/or polynucleotides of the invention include, but are not limited to, vaccines directed toward protection against MMR (measles, mumps, rubella), polio, varicella, tetanus/diptheria, hepatitis A, hepatitis B, *Haemophilus influenzae* B, whooping cough, pneumonia, influenza, Lyme's Disease, rotavirus, cholera, yellow fever, Japanese encephalitis, poliomyelitis, rabies, typhoid fever, and pertussis. Combinations may be administered either concomitantly, e.g., as an admixture, separately but simultaneously or concurrently; or sequentially. This includes presentations in which the combined agents are administered together as a therapeutic mixture, and also procedures in which the combined agents are administered separately but simultaneously, e.g., as through separate intravenous lines into the same individual. Administration "in combination" further includes the separate administration of one of the compounds or agents given first, followed by the second.

The albumin fusion proteins and/or polynucleotides of the invention may be administered alone or in combination with other therapeutic agents. Albumin fusion protein and/or polynucleotide agents that may be administered in combination with the albumin fusion proteins and/or polynucleotides of the invention, include but not limited to, chemotherapeutic agents, antibiotics, steroidal and non-steroidal anti-inflammatories, conventional immunotherapeutic agents, and/or therapeutic treatments described below. Combinations may be administered either concomitantly, e.g., as an admixture, separately but simultaneously or concurrently; or sequentially. This includes presentations in which the combined agents are administered together as a therapeutic mixture, and also procedures in which the combined agents are administered separately but simultaneously, e.g., as through separate intravenous lines into the same individual. Administration "in combination" further includes the separate administration of one of the compounds or agents given first, followed by the second.

In one embodiment, the albumin fusion proteins and/or polynucleotides of the invention are administered in combination with an anticoagulant. Anticoagulants that may be administered with the compositions of the invention include, but are not limited to, heparin, low molecular weight heparin, warfarin sodium (e.g., COUMADIN®), dicumarol, 4-hydroxycoumarin, anisindione (e.g., MIRADON™), acenocoumarol (e.g., nicoumalone, SINTHROME™), indan-1,3-dione, phenprocoumon (e.g., MARCUMAR™), ethyl biscoumacetate (e.g., TROMEXAN™), and aspirin. In a specific embodiment, compositions of the invention are administered in combination with heparin and/or warfarin. In another specific embodiment, compositions of the invention are administered in combination with warfarin. In another specific embodiment, compositions of the invention are administered in combination with warfarin and aspirin. In another specific embodiment, compositions of the invention are administered in combination with heparin. In another specific embodiment, compositions of the invention are administered in combination with heparin and aspirin.

In another embodiment, the albumin fusion proteins and/or polynucleotides of the invention are administered in combination with thrombolytic drugs. Thrombolytic drugs that may be administered with the compositions of the invention include, but are not limited to, plasminogen, lys-plasminogen, alpha2-antiplasmin, streptokinae (e.g., KABIKINASE™), antiresplace (e.g., EMINASE™), tissue plasminogen activator (t-PA, altevase, ACTIVASE™), urokinase (e.g., ABBOKINASE™), sauruplase, (Prourokinase, single chain urokinase), and aminocaproic acid (e.g., AMICAR™). In a specific embodiment, compositions of the invention are administered in combination with tissue plasminogen activator and aspirin.

In another embodiment, the albumin fusion proteins and/or polynucleotides of the invention are administered in combination with antiplatelet drugs. Antiplatelet drugs that may be administered with the compositions of the invention include, but are not limited to, aspirin, dipyridamole (e.g., PERSANTINE™), and ticlopidine (e.g., TICLID™).

In specific embodiments, the use of anti-coagulants, thrombolytic and/or antiplatelet drugs in combination with albumin fusion proteins and/or polynucleotides of the invention is contemplated for the prevention, diagnosis, and/or treatment of thrombosis, arterial thrombosis, venous thrombosis, thromboembolism, pulmonary embolism, atherosclerosis, myocardial infarction, transient ischemic attack, unstable angina. In specific embodiments, the use of anticoagulants, thrombolytic drugs and/or antiplatelet drugs in combination with albumin fusion proteins and/or polynucleotides of the invention is contemplated for the prevention of occlusion of saphenous grafts, for reducing the risk of periprocedural thrombosis as might accompany angioplasty procedures, for reducing the risk of stroke in patients with atrial fibrillation including nonrheumatic atrial fibrillation, for reducing the risk of embolism associated with mechanical heart valves and or mitral valves disease. Other uses for the therapeutics of the invention, alone or in combination with antiplatelet, anticoagulant, and/or thrombolytic drugs, include, but are not limited to, the prevention of occlusions in extracorporeal devices (e.g., intravascular canulas, vascular access shunts in hemodialysis patients, hemodialysis machines, and cardiopulmonary bypass machines).

In certain embodiments, albumin fusion proteins and/or polynucleotides of the invention are administered in combination with antiretroviral agents, nucleoside/nucleotide reverse transcriptase inhibitors (NRTIs), non-nucleoside reverse transcriptase inhibitors (NNRTIs), and/or protease inhibitors (PIs). NRTIs that may be administered in combination with the albumin fusion proteins and/or polynucleotides of the invention, include, but are not limited to, RETROVIR™ (zidovudine/AZT), VIDEX™ (didanosine/ddI), HIVID™ (zalcitabine/ddC), ZERIT™ (stavudine/d4T), EPIVIR™ (lamivudine/3TC), and COMBIVIR™ (zidovudine/lamivudine). NNRTIs that may be administered in combination with the albumin fusion proteins and/or polynucleotides of the invention, include, but are not limited to, VIRAMUNE™ (nevirapine), RESCRIPTOR™ (delavirdine), and SUSTIVA™ (efavirenz). Protease inhibitors that may be administered in combination with the albumin fusion proteins and/or polynucleotides of the invention, include, but are not limited to, CRIXIVAN™ (indinavir), NORVIR™ (ritonavir), INVIRASE™ (saquinavir), and VIRACEPT™ (nelfinavir). In a specific embodiment, antiretroviral agents, nucleoside reverse transcriptase inhibitors, non-nucleoside reverse transcriptase inhibitors, and/or protease inhibitors may be used in any combination with albumin fusion proteins and/or polynucleotides of the invention to treat AIDS and/or to prevent or treat HIV infection.

Additional NRTIs include LODENOSINE™ (F-ddA; an acid-stable adenosine NRTI; Triangle/Abbott; COVIRACIL™ (emtricitabine/FTC; structurally related to lamivudine (3TC) but with 3- to 10-fold greater activity in vitro; Triangle/Abbott); dOTC (BCH-10652, also structurally related to lamivudine but retains activity against a substantial proportion of lamivudine-resistant isolates; Biochem Pharma); Adefovir (refused approval for anti-HIV therapy by FDA; Gilead Sciences); PREVEON® (Adefovir Dipivoxil, the active prodrug of adefovir; its active form is PMEA-pp); TENOFOVIR™ (bis-POC PMPA, a PMPA prodrug; Gilead); DAPD/DXG (active metabolite of DAPD; Triangle/Abbott); D-D4FC (related to 3TC, with activity against AZT/3TC-resistant virus); GW420867X (Glaxo Wellcome); ZIAGEN™ (abacavir/159U89; Glaxo Wellcome Inc.); CS-87 (3'azido-2',3'-dideoxyuridine; WO 99/66936); and S-acyl-2-thioethyl (SATE)-bearing prodrug forms of β-L-FD4C and β-L-FddC (WO 98/17281).

Additional NNRTIs include COACTINON™ (Emivirine/MKC-442, potent NNRTI of the HEPT class; Triangle/Abbott); CAPRAVIRINE™ (AG-1549/S-1153, a next generation NNRTI with activity against viruses containing the K103N mutation; Agouron); PNU-142721 (has 20- to 50-fold greater activity than its predecessor delavirdine and is active against K103N mutants; Pharmacia & Upjohn); DPC-961 and DPC-963 (second-generation derivatives of efavirenz, designed to be active against viruses with the K103N mutation; DuPont); GW-420867×(has 25-fold greater activity than HBY097 and is active against K103N mutants; Glaxo Wellcome); CALANOLIDE A (naturally occurring agent from the latex tree; active against viruses containing either or both the Y181C and K103N mutations); and Propolis (WO 99/49830).

Additional protease inhibitors include LOPINAVIR™ (ABT378/r; Abbott Laboratories); BMS-232632 (an azapeptide; Bristol-Myres Squibb); TIPRANAVIR™ (PNU-140690, a non-peptic dihydropyrone; Pharmacia & Upjohn); PD-178390 (a nonpeptidic dihydropyrone; Parke-Davis); BMS 232632 (an azapeptide; Bristol-Myers Squibb); L-756, 423 (an indinavir analog; Merck); DMP-450 (a cyclic urea compound; Avid & DuPont); AG-1776 (a peptidomimetic with in vitro activity against protease inhibitor-resistant viruses; Agouron); VX-175/GW-433908 (phosphate prodrug of amprenavir; Vertex & Glaxo Welcome); CGP61755 (Ciba); and AGENERASE™ (amprenavir; Glaxo Wellcome Inc.).

Additional antiretroviral agents include fusion inhibitors/gp41 binders. Fusion inhibitors/gp41 binders include T-20 (a peptide from residues 643-678 of the HIV gp41 transmembrane protein ectodomain which binds to gp41 in its resting state and prevents transformation to the fusogenic state; Trimeris) and T-1249 (a second-generation fusion inhibitor; Trimeris).

Additional antiretroviral agents include fusion inhibitors/chemokine receptor antagonists. Fusion inhibitors/chemokine receptor antagonists include CXCR4 antagonists such as AMD 3100 (a bicyclam), SDF-1 and its analogs, and ALX40-4C (a cationic peptide), T22 (an 18 amino acid peptide; Trimeris) and the T22 analogs T134 and T140; CCR5 antagonists such as RANTES (9-68), AOP-RANTES, NNY-RANTES, and TAK-779; and CCR5/CXCR4 antagonists such as NSC 651016 (a distamycin analog). Also included are CCR2B, CCR3, and CCR6 antagonists. Chemokine receptor agonists such as RANTES, SDF-1, MIP-1α, MIP-1β, etc., may also inhibit fusion.

Additional antiretroviral agents include integrase inhibitors. Integrase inhibitors include dicaffeoylquinic (DFQA) acids; L-chicoric acid (a dicaffeoyltartaric (DCTA) acid); quinalizarin (QLC) and related anthraquinones; ZINTEVIR™ (AR 177, an oligonucleotide that probably acts at cell surface rather than being a true integrase inhibitor; Arondex); and naphthols such as those disclosed in WO 98/50347.

Additional antiretroviral agents include hydroxyurea-like compounds such as BCX-34 (a purine nucleoside phosphorylase inhibitor; Biocryst); ribonucleotide reductase inhibitors such as DIDOX™ (Molecules for Health); inosine monophosphate dehydrogenase (IMPDH) inhibitors sucha as VX-497 (Vertex); and mycopholic acids such as CellCept (mycophenolate mofetil; Roche).

Additional antiretroviral agents include inhibitors of viral integrase, inhibitors of viral genome nuclear translocation such as arylene bis(methylketone) compounds; inhibitors of HIV entry such as AOP-RANTES, NNY-RANTES, RANTES-IgG fusion protein, soluble complexes of RANTES and glycosaminoglycans (GAG), and AMD-3100; nucleocapsid zinc finger inhibitors such as dithiane compounds; targets of HIV Tat and Rev; and pharmacoenhancers such as ABT-378.

Other antiretroviral therapies and adjunct therapies include cytokines and lymphokines such as MIP-1α, MIP-1β, SDF-1α, IL-2, PROLEUKIN™ (aldesleukin/L2-7001; Chiron), IL-4, IL-10, IL-12, and IL-13; interferons such as IFN-alpha2a, IFN-alpha2b, or IFN-beta; antagonists of TNFs, NFκB, GM-CSF, M-CSF, and IL-10; agents that modulate immune activation such as cyclosporin and prednisone; vaccines such as Remune™ (HIV Immunogen), APL 400-003 (Apollon), recombinant gp120 and fragments, bivalent (B/E) recombinant envelope glycoprotein, rgp120CM235, MN rgp120, SF-2 rgp120, gp120/soluble CD4 complex, Delta JR-FL protein, branched synthetic peptide derived from discontinuous gp120 C3/C4 domain, fusion-competent immunogens, and Gag, Pol, Nef, and Tat vaccines; gene-based therapies such as genetic suppressor elements (GSEs; WO 98/54366), and intrakines (genetically modified CC chemokines targetted to the ER to block surface expression of newly synthesized CCR5 (Yang et al., *PNAS* 94:11567-72 (1997); Chen et al., *Nat. Med.* 3:1110-16 (1997)); antibodies such as the anti-CXCR4 antibody 12G5, the anti-CCR5 antibodies 2D7, 5C7, PA8, PA9, PA10, PA11, PA12, and PA14, the anti-CD4 antibodies Q4120 and RPA-T4, the anti-CCR3 antibody 7B11, the anti-gp120 antibodies 17b, 48d, 447-52D, 257-D, 268-D and 50.1, anti-Tat antibodies, anti-TNF-α antibodies, and monoclonal antibody 33A; aryl hydrocarbon (AH) receptor agonists and antagonists such as TCDD, 3,3',4,4',5-pentachlorobiphenyl, 3,3',4,4'-tetrachlorobiphenyl, and α-naphthoflavone (WO 98/30213); and antioxidants such as γ-L-glutamyl-L-cysteine ethyl ester (γ-GCE; WO 99/56764).

In a further embodiment, the albumin fusion proteins and/or polynucleotides of the invention are administered in combination with one or more antiviral agent. Antiviral agents that may be administered with the albumin fusion proteins and/or polynucleotides of the invention include, but are not limited to, acyclovir, ribavirin, ribavirin analog, amantadine, remantidine, maxamine, or thymalfasin. In a preferred embodiment, an albumin fusion protein of the invention is administered in combination with ribavirin or a ribavirn analog. In a most preferred embodiment, the ribavirin or ribavirin analogs that may be administered in combination with an albumin fusion protein include but are not limited to COPEGUS® (Hoffman-La Roche, Nutley, N.J.), REBETOL® (Schereing Corp., Kenilworth, N.J.), VIRAZOLE (Valeant, Costa Mesa, Calif.), RIBAVIN™ (Lupin, Baltimore, Md.), RIBAZID™ (Epla, Kirachi, Pakistan), tribavirin, VIRAMIDINE™ (Valeant, Costa Mesa, Calif.), and RIBASPHERE™ (Three Rivers Pharmaceuticals, Cranberry Township, Pa.

In a further embodiment, the albumin fusion proteins and/or polynucleotides of the invention may be administered alone or in combination with one or more antiviral agents for the treatment of viral infection. Antiviral agents that may be administered with the albumin fusion proteins and/or polynucleotides of the invention include, but are not limited to, small-molecule inhibitors of viral enzymes, small-molecule inhibitors of RNA polymerase, nucleic acid based antiviral agents, antisense oligonucleotide inhibitors, thiazolides, novel immunomodulatory agents, and interferon enhancers. Anti-viral enzyme inhibitors that may be administered in combination with the albumin fusion proteins and/or polynucleotides of the invention include, but are not limited to, VX-950 (protease inhibitor, Vertex, Cambridge, Mass.), VX-497 (merimepodib, oral IMPDH inhibitor, Vertex, Cambridge, Mass.), BILB 1941 (protease inhibitor, Boehringer Ingelheim, Germany), SCH7 (protease inhibitor, Schereing Corp., Kenilworth, N.J.), MX-3253 (glucosidase inhibitor, Migenix, Vancouver, BC), IDN-6556 (caspase inhibitor, Pfizer, New York, N.Y.), UT231B (glucosidase inhibitor, United Therapeutics, Silver Spring, Md.). Anti-viral polymerase inhibitors that may be administered in combination with the albumin fusion proteins and/or polynucleotides of the invention may be nucleoside analogs or non-nucleoside inhibitors (NNIs). In a preferred embodiment, the anti-viral polymerase inhibitors inhibit HCV RNA polymerase. In one embodiment, the anti-viral polymerase inhibitors may be nucleotide analogs including, but not limited to, NM283 (oral prodrug of 23'-C-methyl-cytidine, Idenix, Cambride, Mass.), and 2'-C-methyl nucleosides. In another embodiment, the anti-viral polymerase inhibitors may be non-nucleoside inhibitors, including, but not limited to, JTK-103, JTK-003, and JTK-109 (Japan Tabacco, Tokyo, Japan), R803 (Rigel, South San Francisco, Calif.), and HCV-371, HCV-086, and HCV-796 (ViroPharm, Exton, Pa./Wyeth, Madison, N.J.). Anti-viral nucleic acid based agents that may be administered in combination with the albumin fusion proteins and/or polynucleotides of the invention include, but are not limited to, antisense oligonucleotides, ribozymes, and siRNAs or short hairpin RNAs (shRNA). Anti-viral antisense oligonucleotide inhibitor agents that may be administered in combination with the albumin fusion proteins and/or polynucleotides of the invention include, but are not limited to, NEUGENE AVI-4065 (AVI Biopharma, Portland, Oreg.). In another embodiment, a thiazolide may be administered in combination with the albumin fusion proteins and/or polynucleotides of the invention. In a preferred embodiment, thiazolides that may be administered in combination with the albumin fusion proteins and/or polynucleotides of the invention include, but are not limited to ALINIA® (nitazoxanide, Romark Laboratories, L.C., Tampa, Fla.). Anti-viral immunomodulatory agents that may be administered in combination with the albumin fusion proteins and/or polynucleotides of the invention include, but are not limited to, ZADXIN® (thymosin alpha 1, thymalfasin, SciClone Pharmaceuticals Int'l, Hong Kong) and toll-like receptor (TLR) agonists, including, but not limited to, ANA245 (TLR-7 agonist, Anadys Pharmaceuticals, San Diego, Calif.), ANA975 (oral prodrug of ANA245, Anadys Pharmaceuticals, San Diego, Calif.), and CPF-10101 (ACTILON™, TLR-9 agonist, Coley Pharmaceutical Group, Wellesley, Mass.). Interferon enhancers that may be administered in combination with the albumin fusion proteins and/or polynucleotides of the invention include, but are not limited to EMZ702 (Transition Therapeutics, Toronto, Ontario).

In other embodiments, albumin fusion proteins and/or polynucleotides of the invention may be administered in combination with anti-opportunistic infection agents. Anti-opportunistic agents that may be administered in combination with the albumin fusion proteins and/or polynucleotides of the invention, include, but are not limited to, TRIMETHOPRIM-SULFAMETHOXAZOLE™, DAPSONE™, PENTAMIDINE™, ATOVAQUONE™, ISONIAZID™, RIFAMPIN™, PYRAZINAMIDE™, ETHAMBUTOL™, RIFABUTIN™, CLARITHROMYCIN™, AZITHROMYCIN™, GANCICLOVIR™, FOSCARNET™, CIDOFOVIR™, FLUCONAZOLE™, ITRACONAZOLE™, KETOCONAZOLE™, ACYCLOVIR™, FAMCICOLVIR™, PYRIMETHAMINE™, LEUCOVORIN™, NEUPOGEN™ (filgrastim/G-CSF), and LEUKINE™ (sargramostim/GM-CSF). In a specific embodiment, albumin fusion proteins and/or polynucleotides of the invention are used in any combination with TRIMETHOPRIM-SULFAMETHOXAZOLE™, DAPSONE™, PENTAMIDINE™, and/or ATOVAQUONE™ to prophylactically treat or prevent an opportunistic *Pneumocystis carinii* pneumonia infection. In another specific embodiment, albumin fusion proteins and/or polynucleotides of the invention are used in any combination with ISONIAZID™, RIFAMPIN™, PYRAZINAMIDE™, and/or ETHAMBUTOL™ to prophylactically treat or prevent an opportunistic *Mycobacterium avium* complex infection. In another specific embodiment, albumin fusion proteins and/or polynucleotides of the invention are used in any combination with RIFABUTIN™, CLARITHROMYCIN™, and/or AZITHROMYCIN™ to prophylactically treat or prevent an opportunistic *Mycobacterium tuberculosis* infection. In another specific embodiment, albumin fusion proteins and/or polynucleotides of the invention are used in any combination with GANCICLOVIR™, FOSCARNET™, and/or CIDOFOVIR™ to prophylactically treat or prevent an opportunistic cytomegalovirus infection. In another specific embodiment, albumin fusion proteins and/or polynucleotides of the invention are used in any combination with FLUCONAZOLE™, ITRACONAZOLE™, and/or KETOCONAZOLE™ to prophylactically treat or prevent an opportunistic fungal infection. In another specific embodiment, albumin fusion proteins and/or polynucleotides of the invention are used in any combination with ACYCLOVIR™ and/or FAMCICOLVIR™ to prophylactically treat or prevent an opportunistic herpes simplex virus type I and/or type II infection. In another specific embodiment, albumin fusion proteins and/or polynucleotides of the invention are used in any combination with PYRIMETHAMINE™ and/or LEUCOVORIN™ to prophylactically treat or prevent an opportunistic *Toxoplasma gondii* infection. In another specific embodiment, albumin fusion proteins and/or polynucleotides of the invention are used in any combination with LEUCOVORIN™ and/or NEUPOGEN™ to prophylactically treat or prevent an opportunistic bacterial infection.

In a further embodiment, the albumin fusion proteins and/or polynucleotides of the invention are administered in combination with an antibiotic agent. Antibiotic agents that may be administered with the albumin fusion proteins and/or polynucleotides of the invention include, but are not limited to, amoxicillin, beta-lactamases, aminoglycosides, beta-lactam (glycopeptide), beta-lactamases, Clindamycin, chloramphenicol, cephalosporins, ciprofloxacin, erythromycin, fluoroquinolones, macrolides, metronidazole, penicillins, quinolones, rapamycin, rifampin, streptomycin, sulfonamide, tetracyclines, trimethoprim, trimethoprim-sulfamethoxazole, and vancomycin.

In other embodiments, the albumin fusion proteins and/or polynucleotides of the invention are administered in combination with immunestimulants. Immunostimulants that may be administered in combination with the albumin fusion proteins and/or polynucleotides of the invention include, but are not limited to, levamisole (e.g., ERGAMISOL™), isoprinosine (e.g. INOSIPLEX™), interferons (e.g. interferon alpha), and interleukins (e.g., IL-2).

In other embodiments, albumin fusion proteins and/or polynucleotides of the invention are administered in combination with immunosuppressive agents. Immunosuppressive agents that may be administered in combination with the albumin fusion proteins and/or polynucleotides of the invention include, but are not limited to, steroids, cyclosporine, cyclosporine analogs, cyclophosphamide methylprednisone, prednisone, azathioprine, FK-506, 15-deoxyspergualin, and other immunosuppressive agents that act by suppressing the function of responding T cells. Other immunosuppressive agents that may be administered in combination with the albumin fusion proteins and/or polynucleotides of the invention include, but are not limited to, prednisolone, methotrexate, thalidomide, methoxsalen, rapamycin, leflunomide, mizoribine (BREDININ™), brequinar, deoxyspergualin, and azaspirane (SKF 105685), ORTHOCLONE OKT® 3 (muromonab-CD3), SANDIMMUNE™, NEORAL™, SANGDYA™ (cyclosporine), PROGRAF® (FK506, tacrolimus), CELLCEPT® (mycophenolate motefil, of which the active metabolite is mycophenolic acid), IMURAN™ (azathioprine), glucocorticosteroids, adrenocortical steroids such as DELTASONE™ (prednisone) and HYDELTRASOL™ (prednisolone), FOLEX™ and MEXATE™ (methotrxate), OXSORALEN-ULTRA™ (methoxsalen) and RAPAMUNE™ (sirolimus). In a specific embodiment, immunosuppressants may be used to prevent rejection of organ or bone marrow transplantation.

In an additional embodiment, albumin fusion proteins and/or polynucleotides of the invention are administered alone or in combination with one or more intravenous immune globulin preparations. Intravenous immune globulin preparations that may be administered with the albumin fusion proteins and/or polynucleotides of the invention include, but not limited to, GAMMAR™, IVEEGAMυ, SANDOGLOBULIN™, GAMMAGARD S/D™, ATGAM™ (antithymocyte glubulin), and GAMIMUNE™. In a specific embodiment, albumin fusion proteins and/or polynucleotides of the invention are administered in combination with intravenous immune globulin preparations in transplantation therapy (e.g., bone marrow transplant).

In another embodiment, the albumin fusion proteins and/or polynucleotides of the invention are administered alone or as part of a combination therapy, either in vivo to patients or in vitro to cells, for the treatment of cancer. In a specific embodiment, the albumin fusion proteins, particularly IL-2-albumin fusions, are administered repeatedly during passive immunotherapy for cancer, such as adoptive cell transfer therapy for metastatic melanoma as described in Dudley et al. (Science Express, 19 Sep. 2002., at www.scienceexpress.org, hereby incorporated by reference in its entirety).

In certain embodiments, the albumin fusion proteins and/or polynucleotides of the invention are administered alone or in combination with an anti-inflammatory agent. Anti-inflammatory agents that may be administered with the albumin fusion proteins and/or polynucleotides of the invention include, but are not limited to, corticosteroids (e.g. betamethasone, budesonide, cortisone, dexamethasone, hydrocortisone, methylprednisolone, prednisolone, prednisone, and triamcinolone), nonsteroidal anti-inflammatory drugs (e.g., diclofenac, diflunisal, etodolac, fenoprofen, floctafenine, flurbiprofen, ibuprofen, indomethacin, ketoprofen, meclofenamate, mefenamic acid, meloxicam, nabumetone, naproxen, oxaprozin, phenylbutazone, piroxicam, sulindac, tenoxicam, tiaprofenic acid, and tolmetin.), as well as antihistamines, aminoarylcarboxylic acid derivatives, arylacetic acid derivatives, arylbutyric acid derivatives, arylcarboxylic acids, arylpropionic acid derivatives, pyrazoles, pyrazolones, salicylic acid derivatives, thiazinecarboxamides, e-acetamidocaproic acid, S-adenosylmethionine, 3-amino-4-hydroxybutyric acid, amixetrine, bendazac, benzydamine, bucolome, difenpiramide, ditazol, emorfazone, guaiazulene, nabumetone, nimesulide, orgotein, oxaceprol, paranyline, perisoxal, pifoxime, proquazone, proxazole, and tenidap.

In an additional embodiment, the compositions of the invention are administered alone or in combination with an anti-angiogenic agent. Anti-angiogenic agents that may be administered with the compositions of the invention include, but are not limited to, Angiostatin (Entremed, Rockville, Md.), Troponin-1 (Boston Life Sciences, Boston, Mass.), anti-Invasive Factor, retinoic acid and derivatives thereof, paclitaxel (Taxol), Suramin, Tissue Inhibitor of Metalloproteinase-1, Tissue Inhibitor of Metalloproteinase-2, VEGI, Plasminogen Activator Inhibitor-1, Plasminogen Activator Inhibitor-2, and various forms of the lighter “d group” transition metals.

Lighter "d group" transition metals include, for example, vanadium, molybdenum, tungsten, titanium, niobium, and tantalum species. Such transition metal species may form transition metal complexes. Suitable complexes of the above-mentioned transition metal species include oxo transition metal complexes.

Representative examples of vanadium complexes include oxo vanadium complexes such as vanadate and vanadyl complexes. Suitable vanadate complexes include metavanadate and orthovanadate complexes such as, for example, ammonium metavanadate, sodium metavanadate, and sodium orthovanadate. Suitable vanadyl complexes include, for example, vanadyl acetylacetonate and vanadyl sulfate including vanadyl sulfate hydrates such as vanadyl sulfate mono- and trihydrates.

Representative examples of tungsten and molybdenum complexes also include oxo complexes. Suitable oxo tungsten complexes include tungstate and tungsten oxide complexes. Suitable tungstate complexes include ammonium tungstate, calcium tungstate, sodium tungstate dihydrate, and tungstic acid. Suitable tungsten oxides include tungsten (IV) oxide and tungsten (VI) oxide. Suitable oxo molybdenum complexes include molybdate, molybdenum oxide, and molybdenyl complexes. Suitable molybdate complexes include ammonium molybdate and its hydrates, sodium molybdate and its hydrates, and potassium molybdate and its hydrates. Suitable molybdenum oxides include molybdenum (VI) oxide, molybdenum (VI) oxide, and molybdic acid. Suitable molybdenyl complexes include, for example, molybdenyl acetylacetonate. Other suitable tungsten and molybdenum complexes include hydroxo derivatives derived from, for example, glycerol, tartaric acid, and sugars.

A wide variety of other anti-angiogenic factors may also be utilized within the context of the present invention. Representative examples include, but are not limited to, platelet factor 4; protamine sulphate; sulphated chitin derivatives (prepared from queen crab shells), (Murata et al., Cancer Res. 51:22-26, (1991)); Sulphated Polysaccharide Peptidoglycan Complex (SP-PG) (the function of this compound may be enhanced by the presence of steroids such as estrogen, and tamoxifen citrate); Staurosporine; modulators of matrix metabolism, including for example, proline analogs, cishydroxyproline, d,L-3,4-dehydroproline, Thiaproline, alpha,alpha-dipyridyl, aminopropionitrile fumarate; 4-propyl-5-(4-pyridinyl)-2(3H)-oxazolone; Methotrexate; Mitoxantrone; Heparin; Interferons; 2 Macroglobulin-serum; ChIMP-3 (Pavloff et al., J. Bio. Chem. 267:17321-17326, (1992)); Chymostatin (Tomikinson et al., Biochem J. 286:475-480, (1992)); Cyclodextrin Tetradecasulfate; Eponemycin; Camptothecin; Fumagillin (Ingber et al., Nature 348:555-557, (1990)); Gold Sodium Thiomalate ("GST"; Matsubara and Ziff, J. Clin. Invest. 79:1440-1446, (1987)); anticollagenase-serum; alpha2-antiplasmin (Holmes et al., J. Biol. Chem. 262(4):1659-1664, (1987)); Bisantrene (National Cancer Institute); Lobenzarit disodium (N-(2)-carboxyphenyl-4-chloroanthronilic acid disodium or "CCA"; (Takeuchi et al., Agents Actions 36:312-316, (1992)); and metalloproteinase inhibitors such as BB94.

Additional anti-angiogenic factors that may also be utilized within the context of the present invention include Thalidomide, (Celgene, Warren, N.J.); Angiostatic steroid; AGM-1470 (H. Brem and J. Folkman *J Pediatr. Surg.* 28:445-51 (1993)); an integrin alpha v beta 3 antagonist (C. Storgard et al., *J Clin. Invest.* 103:47-54 (1999)); carboxynaminolmidazole; Carboxyamidotriazole (CAI) (National Cancer Institute, Bethesda, Md.); Conbretastatin A-4 (CA4P) (OXiGENE, Boston, Mass.); Squalamine (Magainin Pharmaceuticals, Plymouth Meeting, Pa.); TNP-470, (Tap Pharmaceuticals, Deerfield, Ill.); ZD-0101 AstraZeneca (London, UK); APRA (CT2584); Benefin, Byrostatin-1 (SC339555); CGP-41251 (PKC 412); CM101; Dexrazoxane (ICRF187); DMXAA; Endostatin; Flavopridiol; Genestein; GTE; ImmTher; Iressa (ZD1839); Octreotide (Somatostatin); Panretin; Penacillamine; Photopoint; PI-88; Prinomastat (AG-3340) Purlytin; Suradista (FCE26644); Tamoxifen (Nolvadex); Tazarotene; Tetrathiomolybdate; Xeloda (Capecitabine); and 5-Fluorouracil.

Anti-angiogenic agents that may be administed in combination with the compounds of the invention may work through a variety of mechanisms including, but not limited to, inhibiting proteolysis of the extracellular matrix, blocking the function of endothelial cell-extracellular matrix adhesion molecules, by antagonizing the function of angiogenesis inducers such as growth factors, and inhibiting integrin receptors expressed on proliferating endothelial cells. Examples of anti-angiogenic inhibitors that interfere with extracellular matrix proteolysis and which may be administered in combination with the compositons of the invention include, but are not limited to, AG-3340 (Agouron, La Jolla, Calif.), BAY-12-9566 (Bayer, West Haven, Conn.), BMS-275291 (Bristol Myers Squibb, Princeton, N.J.), CGS-27032A (Novartis, East Hanover, N.J.), Marimastat (British Biotech, Oxford, UK), and Metastat (Aetema, St-Foy, Quebec). Examples of anti-angiogenic inhibitors that act by blocking the function of endothelial cell-extracellular matrix adhesion molecules and which may be administered in combination with the compositons of the invention include, but are not limited to, EMD-121974 (Merck KcgaA Darmstadt, Germany) and Vitaxin (Ixsys, La Jolla, Calif./Medimmune, Gaithersburg, Md.). Examples of anti-angiogenic agents that act by directly antagonizing or inhibiting angiogenesis inducers and which may be administered in combination with the compositons of the invention include, but are not limited to, Angiozyme (Ribozyme, Boulder, Colo.), Anti-VEGF antibody (Genentech, S. San Francisco, Calif.), PTK-787/ZK-225846 (Novartis, Basel, Switzerland), SU-101 (Sugen, S. San Francisco, Calif.), SU-5416 (Sugen/Pharmacia Upjohn, Bridgewater, N.J.), and SU-6668 (Sugen). Other anti-angiogenic agents act to indirectly inhibit angiogenesis. Examples of indirect inhibitors of angiogenesis which may be administered in combination with the compositons of the invention include, but are not limited to, IM-862 (Cytran, Kirkland, Wash.), Interferon-alpha, IL-12 (Roche, Nutley, N.J.), and Pentosan polysulfate (Georgetown University, Washington, D.C.).

In particular embodiments, the use of compositions of the invention in combination with anti-angiogenic agents is contemplated for the treatment, prevention, and/or amelioration of an autoimmune disease, such as for example, an autoimmune disease described herein.

In a particular embodiment, the use of compositions of the invention in combination with anti-angiogenic agents is contemplated for the treatment, prevention, and/or amelioration of arthritis. In a more particular embodiment, the use of compositions of the invention in combination with anti-angiogenic agents is contemplated for the treatment, prevention, and/or amelioration of rheumatoid arthritis.

In another embodiment, the polynucleotides encoding a polypeptide of the present invention are administered in combination with an angiogenic protein, or polynucleotides encoding an angiogenic protein. Examples of angiogenic proteins that may be administered with the compositions of the invention include, but are not limited to, acidic and basic fibroblast growth factors, VEGF-1, VEGF-2, VEGF-3, epidermal growth factor alpha and beta, platelet-derived endothelial cell growth factor, platelet-derived growth factor, tumor necrosis factor alpha, hepatocyte growth factor, insulin-like growth factor, colony stimulating factor, macrophage colony stimulating factor, granulocyte/macrophage colony stimulating factor, and nitric oxide synthase.

In additional embodiments, compositions of the invention are administered in combination with a chemotherapeutic agent. Chemotherapeutic agents that may be administered with the albumin fusion proteins and/or polynucleotides of the invention include, but are not limited to alkylating agents such as nitrogen mustards (for example, Mechlorethamine, cyclophosphamide, Cyclophosphamide Ifosfamide, Melphalan (L-sarcolysin), and Chlorambucil), ethylenimines and methylmelamines (for example, Hexamethylmelamine and Thiotepa), alkyl sulfonates (for example, Busulfan), nitrosoureas (for example, Carmustine (BCNU), Lomustine (CCNU), Semustine (methyl-CCNU), and Streptozocin (streptozotocin)), triazenes (for example, Dacarbazine (DTIC; dimethyltriazenoimidazolecarboxamide)), folic acid analogs (for example, Methotrexate (amethopterin)), pyrimidine analogs (for example, Fluorouacil (5-fluorouracil; 5-FU), Floxuridine (fluorodeoxyuridine; FudR), and Cytarabine (cytosine arabinoside)), purine analogs and related inhibitors (for example, Mercaptopurine (6-mercaptopurine; 6-MP), Thioguanine (6-thioguanine; TG), and Pentostatin (2'-deoxycoformycin)), vinca alkaloids (for example, Vinblastine (VLB, vinblastine sulfate)) and Vincristine (vincristine sulfate)), epipodophyllotoxins (for example, Etoposide and Teniposide), antibiotics (for example, Dactinomycin (actinomycin D), Daunorubicin (daunomycin; rubidomycin), Doxorubicin, Bleomycin, Plicamycin (mithramycin), and Mitomycin (mitomycin C), enzymes (for example, L-Asparaginase), biological response modifiers (for example, Interferon-alpha and interferon-alpha-2b), platinum coordination compounds (for example, Cisplatin (cis-DDP) and Carboplatin), anthracenedione (Mitoxantrone), substituted ureas (for example, Hydroxyurea), methylhydrazine derivatives (for example, Procarbazine (N-methylhydrazine; MIH), adrenocorticosteroids (for example, Prednisone), progestins (for example, Hydroxyprogesterone caproate, Medroxyprogesterone, Medroxyprogesterone acetate, and Megestrol acetate), estrogens (for example, Diethylstilbestrol (DES), Diethylstilbestrol diphosphate, Estradiol, and Ethinyl estradiol), antiestrogens (for example, Tamoxifen), androgens (Testosterone proprionate, and Fluoxymesterone), antiandrogens (for example, Flutamide), gonadotropin-releasing hormone analogs (for example, Leuprolide), other hormones and hormone analogs (for example, methyltestosterone, estramustine, estramustine phosphate sodium, chlorotrianisene, and testolactone), and others (for example, dicarbazine, glutamic acid, and mitotane).

In one embodiment, the compositions of the invention are administered in combination with one or more of the following drugs: infliximab (also known as Remicade™ Centocor, Inc.), Trocade (Roche, RO-32-3555), Leflunomide (also known as Arava™ from Hoechst Marion Roussel), Kineret™ (an IL-1 Receptor antagonist also known as Anakinra from Amgen, Inc.)

In a specific embodiment, compositions of the invention are administered in combination with CHOP (cyclophosphamide, doxorubicin, vincristine, and prednisone) or combination of one or more of the components of CHOP. In one embodiment, the compositions of the invention are administered in combination with anti-CD20 antibodies, human monoclonal anti-CD20 antibodies. In another embodiment, the compositions of the invention are administered in combination with anti-CD20 antibodies and CHOP, or anti-CD20 antibodies and any combination of one or more of the components of CHOP, particularly cyclophosphamide and/or prednisone. In a specific embodiment, compositions of the invention are administered in combination with Rituximab. In a further embodiment, compositions of the invention are administered with Rituximab and CHOP, or Rituximab and any combination of one or more of the components of CHOP, particularly cyclophosphamide and/or prednisone. In a specific embodiment, compositions of the invention are administered in combination with tositumomab. In a further embodiment, compositions of the invention are administered with tositumomab and CHOP, or tositumomab and any combination of one or more of the components of CHOP, particularly cyclophosphamide and/or prednisone. The anti-CD20 antibodies may optionally be associated with radioisotopes, toxins or cytotoxic prodrugs.

In another specific embodiment, the compositions of the invention are administered in combination Zevalin™. In a further embodiment, compositions of the invention are administered with Zevalin™ and CHOP, or Zevalin™ and any combination of one or more of the components of CHOP, particularly cyclophosphamide and/or prednisone. Zevalin™ may be associated with one or more radisotopes. Particularly preferred isotopes are $^{90}$Y and $^{111}$In.

In an additional embodiment, the albumin fusion proteins and/or polynucleotides of the invention are administered in combination with cytokines. Cytokines that may be administered with the albumin fusion proteins and/or polynucleotides of the invention include, but are not limited to, IL2, IL3, IL4, IL5, IL6, IL7, IL10, IL12, IL13, IL15, anti-CD40, CD40L, IFN-gamma and TNF-alpha. In another embodiment, albumin fusion proteins and/or polynucleotides of the invention may be administered with any interleukin, including, but not limited to, IL-1 alpha, IL-1beta, IL-2, IL-3, IL-4, IL-5, IL-6, IL-7, IL-8, IL-9, IL-10, IL-11, IL-12, IL-13, IL-14, IL-15, IL-16, IL-17, IL-18, IL-19, IL-20, and IL-21.

In one embodiment, the albumin fusion proteins and/or polynucleotides of the invention are administered in combination with members of the TNF family. TNF, TNF-related or TNF-like molecules that may be administered with the albumin fusion proteins and/or polynucleotides of the invention include, but are not limited to, soluble forms of TNF-alpha, lymphotoxin-alpha (LT-alpha, also known as TNF-beta), LT-beta (found in complex heterotrimer LT-alpha2-beta), OPGL, FasL, CD27L, CD30L, CD40L, 4-1BBL, DcR3, OX40L, TNF-gamma (International Publication No. WO 96/14328), AIM-I (International Publication No. WO 97/33899), endokine-alpha (International Publication No. WO 98/07880), OPG, and neutrokine-alpha (International Publication No. WO 98/18921, OX40, and nerve growth factor (NGF), and soluble forms of Fas, CD30, CD27, CD40 and 4-IBB, TR2 (International Publication No. WO 96/34095), DR3 (International Publication No. WO 97/33904), DR4 (International Publication No. WO 98/32856), TR5 (International Publication No. WO 98/30693), TRANK, TR9 (International Publication No. WO 98/56892), TR10 (International Publication No. WO 98/54202), 312C2 (International Publication No. WO 98/06842), and TR12, and soluble forms CD154, CD70, and CD153.

In an additional embodiment, the albumin fusion proteins and/or polynucleotides of the invention are administered in combination with angiogenic proteins. Angiogenic proteins that may be administered with the albumin fusion proteins and/or polynucleotides of the invention include, but are not limited to, Glioma Derived Growth Factor (GDGF), as disclosed in European Patent Number EP-399816; Platelet Derived Growth Factor-A (PDGF-A), as disclosed in European Patent Number EP-682110; Platelet Derived Growth Factor-B (PDGF-B), as disclosed in European Patent Number EP-282317; Placental Growth Factor (PlGF), as disclosed in International Publication Number WO 92/06194; Placental Growth Factor-2 (PlGF-2), as disclosed in Hauser et al., Growth Factors, 4:259-268 (1993); Vascular Endothelial Growth Factor (VEGF), as disclosed in International Publication Number WO 90/13649; Vascular Endothelial Growth Factor-A (VEGF-A), as disclosed in European Patent Number EP-506477; Vascular Endothelial Growth Factor-2 (VEGF-2), as disclosed in International Publication Number WO 96/39515; Vascular Endothelial Growth Factor B (VEGF-3); Vascular Endothelial Growth Factor B-186 (VEGF-B186), as disclosed in International Publication Number WO 96/26736; Vascular Endothelial Growth Factor-D (VEGF-D), as disclosed in International Publication Number WO 98/02543; Vascular Endothelial Growth Factor-D (VEGF-D), as disclosed in International Publication Number WO 98/07832; and Vascular Endothelial Growth Factor-E (VEGF-E), as disclosed in German Patent Number DE19639601. The above mentioned references are herein incorporated by reference in their entireties.

In an additional embodiment, the albumin fusion proteins and/or polynucleotides of the invention are administered in combination with Fibroblast Growth Factors. Fibroblast Growth Factors that may be administered with the albumin fusion proteins and/or polynucleotides of the invention include, but are not limited to, FGF-1, FGF-2, FGF-3, FGF-4, FGF-5, FGF-6, FGF-7, FGF-8, FGF-9, FGF-10, FGF-11, FGF-12, FGF-13, FGF-14, and FGF-15.

In an additional embodiment, the albumin fusion proteins and/or polynucleotides of the invention are administered in combination with hematopoietic growth factors. Hematopoietic growth factors that may be administered with the albumin fusion proteins and/or polynucleotides of the invention include, but are not limited to, granulocyte macrophage colony stimulating factor (GM-CSF) (sargramostim, LEUKINE™, PROKINE™), granulocyte colony stimulating factor (G-CSF) (filgrastim, NEUPOGEN™), macrophage colony stimulating factor (M-CSF, CSF-1) erythropoietin (epoetin alfa, EPOGEN™, PROCRIT™), stem cell factor (SCF, c-kit ligand, steel factor), megakaryocyte colony stimulating factor, PIXY321 (a GMCSF/IL-3 fusion protein), interleukins, especially any one or more of IL-1 through IL-12, interferon-gamma, or thrombopoietin.

In certain embodiments, albumin fusion proteins and/or polynucleotides of the present invention are administered in combination with adrenergic blockers, such as, for example, acebutolol, atenolol, betaxolol, bisoprolol, carteolol, labetalol, metoprolol, nadolol, oxprenolol, penbutolol, pindolol, propranolol, sotalol, and timolol.

In another embodiment, the albumin fusion proteins and/or polynucleotides of the invention are administered in combination with an antiarrhythmic drug (e.g., adenosine, amidoarone, bretylium, digitalis, digoxin, digitoxin, diliazem, disopyramide, esmolol, flecamide, lidocaine, mexiletine, moricizine, phenyloin, procainamide, N-acetyl procainamide, propafenone, propranolol, quinidine, sotalol, tocamide, and verapamil).

In another embodiment, the albumin fusion proteins and/or polynucleotides of the invention are administered in combination with diuretic agents, such as carbonic anhydrase-inhibiting agents (e.g., acetazolamide, dichlorphenamide, and methazolamide), osmotic diuretics (e.g., glycerin, isosorbide, mannitol, and urea), diuretics that inhibit $Na^+$-$K^+$-$2Cl^-$ symport (e.g., furosemide, bumetanide, azosemide, piretanide, tripamide, ethacrynic acid, muzolimine, and torsemide), thiazide and thiazide-like diuretics (e.g., bendroflumethiazide, benzthiazide, chlorothiazide, hydrochlorothiazide, hydroflumethiazide, methyclothiazide, polythiazide, trichormethiazide, chlorthalidone, indapamide, metolazone, and quinethazone), potassium sparing diuretics (e.g., amiloride and triamterene), and mineralcorticoid receptor antagonists (e.g., spironolactone, canrenone, and potassium canrenoate).

In one embodiment, the albumin fusion proteins and/or polynucleotides of the invention are administered in combination with treatments for endocrine and/or hormone imbalance disorders. Treatments for endocrine and/or hormone imbalance disorders include, but are not limited to, $^{127}I$, radioactive isotopes of iodine such as $^{131}I$ and $^{123}I$; recombinant growth hormone, such as HUMATROPE™ (recombinant somatropin); growth hormone analogs such as PROTROPIN™ (somatrem); dopamine agonists such as PARLODEL™ (bromocriptine); somatostatin analogs such as SANDOSTATIN™ (octreotide); gonadotropin preparations such as PREGNYL™, A.P.L.™ and PROFASI™ (chorionic gonadotropin (CG)), PERGONAL™ (menotropins), and METRODIN™ (urofollitropin (uFSH)); synthetic human gonadotropin releasing hormone preparations such as FACTREL™ and LUTREPULSE™ (gonadorelin hydrochloride); synthetic gonadotropin agonists such as LUPRON™ (leuprolide acetate), SUPPRELIN™ (histrelin acetate), SYNAREL™ (nafarelin acetate), and ZOLADEX™ (goserelin acetate); synthetic preparations of thyrotropin-releasing hormone such as RELEFACT TRH™ and THYPINONE™ (protirelin); recombinant human TSH such as THYROGEN™; synthetic preparations of the sodium salts of the natural isomers of thyroid hormones such as L-$T_4$™, SYNTHROID™ and LEVOTHROID™ (levothyroxine sodium), L-$T_3$™, CYTOMEL™ and TRIOSTAT™ (liothyroine sodium), and THYROLAR™ (liotrix); antithyroid compounds such as 6-n-propylthiouracil (propylthiouracil), 1-methyl-2-mercaptoimidazole and TAPAZOLE™ (methimazole), NEO-MERCAZOLE™ (carbimazole); beta-adrenergic receptor antagonists such as propranolol and esmolol; $Ca^{2+}$ channel blockers; dexamethasone and iodinated radiological contrast agents such as TELEPAQUE™ (iopanoic acid) and ORAGRAFIN™ (sodium ipodate).

Additional treatments for endocrine and/or hormone imbalance disorders include, but are not limited to, estrogens or congugated estrogens such as ESTRACE™ (estradiol), ESTINYL™ (ethinyl estradiol), PREMARIN™, ESTRATAB™, ORTHO-EST™, OGEN™ and estropipate (estrone), ESTROVIS™ (quinestrol), ESTRADERM™ (estradiol), DELESTROGEN™ and VALERGEN™ (estradiol valerate), DEPO-ESTRADIOL CYPIONATE™ and ESTROJECT LA™ (estradiol cypionate); antiestrogens such as NOLVADEX™ (tamoxifen), SEROPHENE™ and CLOMID™ (clomiphene); progestins such as DURALUTIN™ (hydroxyprogesterone caproate), MPA™ and DEPO-PROVERA™ (medroxyprogesterone acetate), PROVERA™ and CYCRIN™ (MPA), MEGACE™ (megestrol acetate), NORLUTIN™ (norethindrone), and NORLUTATE™ and AYGESTIN™ (norethindrone acetate); progesterone implants such as NORPLANT SYSTEM™ (subdermal implants of norgestrel); antiprogestins such as RU 486™ (mifepristone); hormonal contraceptives such as ENOVID™ (norethynodrel plus mestranol), PROGESTASERT™ (intrauterine device that releases progesterone), LOESTRIN™, BREVICON™, MODICON™, GENORA™, NELONA™, NORINYL™, OVACON-35 ™ and OVACON-50™ (ethinyl estradiol/norethindrone), LEVLEN™, NORDETTE™, TRI-LEVLEN™ and TRIPHASIL-21™ (ethinyl estradiol/levonorgestrel) LO/OVRAL™ and OVRAL™ (ethinyl estradiol/norgestrel), DEMULEN™ (ethinyl estradiol/ethynodiol diacetate), NORINYL™, ORTHO-NOVUM™, NORETHIN™, GENORA™, and NELOVA™ (norethindrone/mestranol), DESOGEN™ and ORTHO-CEPT™ (ethinyl estradioudesogestrel), ORTHO-CYCLEN™ and ORTHO-TRICYCLEN™ (ethinyl estradiol/norgestimate), MICRONOR™ and NOR-QD™ (norethindrone), and OVRETTE™ (norgestrel).

Additional treatments for endocrine and/or hormone imbalance disorders include, but are not limited to, testosterone esters such as methenolone acetate and testosterone undecanoate; parenteral and oral androgens such as TESTOJECT-50™ (testosterone), TESTEX™ (testosterone propionate), DELATESTRYL™ (testosterone enanthate), DEPO-TESTOSTERONE™ (testosterone cypionate), DANOCRINE™ (danazol), HALOTESTIN™ (fluoxymesterone), ORETON METHYL™, TESTRED™ and VIRILON™ (methyltestosterone), and OXANDRIN™ (oxandrolone); testosterone transdermal systems such as TESTODERM™; androgen receptor antagonist and 5-alpha-reductase inhibitors such as ANDROCUR™ (cyproterone acetate), EULEXIN™ (flutamide), and PROSCAR™ (finasteride); adrenocorticotropic hormone preparations such as CORTROSYN™ (cosyntropin); adrenocortical steroids and their synthetic analogs such as ACLOVATE™ (alclometasone dipropionate), CYCLOCORT™ (amcinonide), BECLOVENT™ and VANCERIL™ (beclomethasone dipropionate), CELESTONE™ (betamethasone), BENISONE™ and UTICORT™ (betamethasone benzoate), DIPROSONE™ (betamethasone dipropionate), CELESTONE PHOSPHATE™ (betamethasone sodium phosphate), CELESTONE SOLUSPAN™ (betamethasone sodium phosphate and acetate), BETA-VAL™ and VALISONE™ (betamethasone valerate), TEMOVATE™ (clobetasol propionate), CLODERM™ (clocortolone pivalate), CORTEF™ and HYDROCORTONE™ (cortisol (hydrocortisone)), HYDROCORTONE ACETATE™ (cortisol (hydrocortisone) acetate), LOCOID™ (cortisol (hydrocortisone) butyrate), HYDROCORTONE PHOSPHATE™ (cortisol (hydrocortisone) sodium phosphate), A-HYDROCORT™ and SOLU CORTEF™ (cortisol (hydrocortisone) sodium succinate), WESTCORT™ (cortisol (hydrocortisone) valerate), CORTISONE ACETATE™ (cortisone acetate), DESOWEN™ and TRIDESILON™ (desonide), TOPICORT™ (desoximetasone), DECADRON™ (dexamethasone), DECADRON LA™ (dexamethasone acetate), DECADRON PHOSPHATE™ and HEXADROL PHOSPHATE™ (dexamethasone sodium phosphate), FLORONE™ and MAXIFLOR™ (diflorasone diacetate), FLORINEF ACETATE™ (fludrocortisone acetate), AEROBID™ and NASALIDE™ (flunisolide), FLUONID™ and SYNALAR™ (fluocinolone acetonide), LIDEX™ (fluocinonide), FLUOR-OP™ and FML™ (fluorometholone), CORDRAN™ (flurandrenolide), HALOG™ (halcinonide), HMS LIZUIFILM™ (medrysone), MEDROL™ (methylprednisolone), DEPO-MEDROL™ and MEDROL ACETATE™ (methylprednisone acetate), A-METHAPRED™ and SOLUMEDROL™ (methylprednisolone sodium succinate), ELOCON™ (mometasone furoate), HALDRONE™ (paramethasone acetate), DELTA-CORTEF™ (prednisolone), ECONOPRED™ (prednisolone acetate), HYDELTRASOL™ (prednisolone sodium phosphate), HYDELTRA-T.B.A™ (prednisolone tebutate), DELTASONE™ (prednisone), ARISTOCORT™ and KENACORT™ (triamcinolone), KENALOG™ (triamcinolone acetonide), ARISTOCORT™ and KENACORT DIACETATE™ (triamcinolone diacetate), and ARISTOSPAN™ (triamcinolone hexacetonide); inhibitors of biosynthesis and action of adrenocortical steroids such as CYTADREN™ (aminoglutethimide), NIZORAL™ (ketoconazole), MODRASTANE™ (trilostane), and METOPIRONE™ (metyrapone); bovine, porcine or human insulin or mixtures thereof; insulin analogs; recombinant human insulin such as HUMULIN™ and NOVOLIN™; oral hypoglycemic agents such as ORAMIDE™ and ORINASE™ (tolbutamide), DIABINESE™ (chlorpropamide), TOLAMIDE™ and TOLINASE™ (tolazamide), DYMELOR™ (acetohexamide), glibenclamide, MICRONASE™, DIBETA™ and GLYNASE™ (glyburide), GLUCOTROL™ (glipizide), and DIAMICRON™ (gliclazide), GLUCOPHAGE™ (metformin), ciglitazone, pioglitazone, and alpha-glucosidase inhibitors; bovine or porcine glucagon; somatostatins such as SANDOSTATIN™ (octreotide); and diazoxides such as PROGLYCEM™ (diazoxide).

In one embodiment, the albumin fusion proteins and/or polynucleotides of the invention are administered in combination with treatments for uterine motility disorders. Treatments for uterine motility disorders include, but are not limited to, estrogen drugs such as conjugated estrogens (e.g., PREMARIN® and ESTRATAB®), estradiols (e.g., CLIMARA® and ALORA®), estropipate, and chlorotrianisene; progestin drugs (e.g., AMEN® (medroxyprogesterone), MICRONOR® (norethidrone acetate), PROMETRIUM® progesterone, and megestrol acetate); and estrogen/progesterone combination therapies such as, for example, conjugated estrogens/medroxyprogesterone (e.g., PREMPRO™ and PREMPHASE®) and norethindrone acetate/ethinyl estsradiol (e.g., FEMHRT™).

In an additional embodiment, the albumin fusion proteins and/or polynucleotides of the invention are administered in combination with drugs effective in treating iron deficiency and hypochromic anemias, including but not limited to, ferrous sulfate (iron sulfate, FEOSOL™), ferrous fumarate (e.g., FEOSTAT™), ferrous gluconate (e.g., FERGON™), polysaccharide-iron complex (e.g., NIFEREX™), iron dextran injection (e.g., INFED™), cupric sulfate, pyroxidine, riboflavin, Vitamin $B_{12}$, cyancobalamin injection (e.g., REDISOL™, RUBRAMIN PC™), hydroxocobalamin, folic acid (e.g., FOLVITE™), leucovorin (folinic acid, 5-CHOH4PteGlu, citrovorum factor) or WELLCOVORIN (Calcium salt of leucovorin), transferrin or ferritin.

In certain embodiments, the albumin fusion proteins and/or polynucleotides of the invention are administered in combination with agents used to treat psychiatric disorders. Psychiatric drugs that may be administered with the albumin fusion proteins and/or polynucleotides of the invention include, but are not limited to, antipsychotic agents (e.g., chlorpromazine, chlorprothixene, clozapine, fluphenazine, haloperidol, loxapine, mesoridazine, molindone, olanzapine, perphenazine, pimozide, quetiapine, risperidone, thioridazine, thiothixene, trifluoperazine, and triflupromazine), antimanic agents (e.g., carbamazepine, divalproex sodium, lithium carbonate, and lithium citrate), antidepressants (e.g., amitriptyline, amoxapine, bupropion, citalopram, clomipramine, desipramine, doxepin, fluvoxamine, fluoxetine, imipramine, isocarboxazid, maprotiline, mirtazapine, nefazodone, nortriptyline, paroxetine, phenelzine, protriptyline, sertraline, tranylcypromine, trazodone, trimipramine, and venlafaxine), antianxiety agents (e.g., alprazolam, buspirone, chlordiazepoxide, clorazepate, diazepam, halazepam, lorazepam, oxazepam, and prazepam), and stimulants (e.g., d-amphetamine, methylphenidate, and pemoline).

In other embodiments, the albumin fusion proteins and/or polynucleotides of the invention are administered in combination with agents used to treat neurological disorders. Neurological agents that may be administered with the albumin fusion proteins and/or polynucleotides of the invention include, but are not limited to, antiepileptic agents (e.g., carbamazepine, clonazepam, ethosuximide, phenobarbital, phenyloin, primidone, valproic acid, divalproex sodium, felbamate, gabapentin, lamotrigine, levetiracetam, oxcarbazepine, tiagabine, topiramate, zonisamide, diazepam, lorazepam, and clonazepam), antiparkinsonian agents (e.g., levodopa/carbidopa, selegiline, amantidine, bromocriptine, pergolide, ropinirole, pramipexole, benztropine; biperiden; ethopropazine; procyclidine; trihexyphenidyl, tolcapone), and ALS therapeutics (e.g. riluzole).

In another embodiment, albumin fusion proteins and/or polynucleotides of the invention are administered in combination with vasodilating agents and/or calcium channel blocking agents. Vasodilating agents that may be administered with the albumin fusion proteins and/or polynucleotides of the invention include, but are not limited to, Angiotensin Converting Enzyme (ACE) inhibitors (e.g., papaverine, isoxsuprine, benazepril, captopril, cilazapril, enalapril, enalaprilat, fosinopril, lisinopril, moexipril, perindopril, quinapril, ramipril, spirapril, trandolapril, and nylidrin), and nitrates (e.g., isosorbide dinitrate, isosorbide mononitrate, and nitroglycerin). Examples of calcium channel blocking agents that may be administered in combination with the albumin fusion proteins and/or polynucleotides of the invention include, but are not limited to amlodipine, bepridil, diltiazem, felodipine, flunarizine, isradipine, nicardipine, nifedipine, nimodipine, and verapamil.

In certain embodiments, the albumin fusion proteins and/or polynucleotides of the invention are administered in combination with treatments for gastrointestinal disorders. Treatments for gastrointestinal disorders that may be administered with the albumin fusion protein and/or polynucleotide of the invention include, but are not limited to, H2 histamine receptor antagonists (e.g., TAGAMET™ (cimetidine), ZANTAC™ (ranitidine), PEPCID™ (famotidine), and AXID™ (nizatidine)); inhibitors of $H^+$, $K^+$ ATPase (e.g., PREVACID™ (lansoprazole) and PRILOSEC™ (omeprazole)); Bismuth compounds (e.g., PEPTO-BISMOL™ (bismuth subsalicylate) and DE-NOL™ (bismuth subcitrate)); various antacids; sucralfate; prostaglandin analogs (e.g. CYTOTEC™ (misoprostol)); muscarinic cholinergic antagonists; laxatives (e.g., surfactant laxatives, stimulant laxatives, saline and osmotic laxatives); antidiarrheal agents (e.g., LOMOTIL™ (diphenoxylate), MOTOFEN™ (diphenoxin), and IMODIUM™ (loperamide hydrochloride)), synthetic analogs of somatostatin such as SANDOSTATIN™ (octreotide), antiemetic agents (e.g., ZOFRAN™ (ondansetron), KYTRIL™ (granisetron hydrochloride), tropisetron, dolasetron, metoclopramide, chlorpromazine, perphenazine, prochlorperazine, promethazine, thiethylperazine, triflupromazine, domperidone, haloperidol, droperidol, trimethobenzamide, dexamethasone, methylprednisolone, dronabinol, and nabilone); D2 antagonists (e.g., metoclopramide, trimethobenzamide and chlorpromazine); bile salts; chenodeoxycholic acid; ursodeoxycholic acid; and pancreatic enzyme preparations such as pancreatin and pancrelipase.

In additional embodiments, the albumin fusion proteins and/or polynucleotides of the invention are administered in combination with other therapeutic or prophylactic regimens, such as, for example, radiation therapy.

The invention also provides a pharmaceutical pack or kit comprising one or more containers filled with one or more of the ingredients of the pharmaceutical compositions comprising albumin fusion proteins of the invention. Optionally associated with such container(s) can be a notice in the form prescribed by a governmental agency regulating the manufacture, use or sale of pharmaceuticals or biological products, which notice reflects approval by the agency of manufacture, use or sale for human administration.

Gene Therapy

Constructs encoding albumin fusion proteins of the invention can be used as a part of a gene therapy protocol to deliver therapeutically effective doses of the albumin fusion protein. A preferred approach for in vivo introduction of nucleic acid into a cell is by use of a viral vector containing nucleic acid, encoding an albumin fusion protein of the invention. Infection of cells with a viral vector has the advantage that a large proportion of the targeted cells can receive the nucleic acid. Additionally, molecules encoded within the viral vector, e.g., by a cDNA contained in the viral vector, are expressed efficiently in cells which have taken up viral vector nucleic acid.

Retrovirus vectors and adeno-associated virus vectors can be used as a recombinant gene delivery system for the transfer of exogenous nucleic acid molecules encoding albumin fusion proteins in vivo. These vectors provide efficient delivery of nucleic acids into cells, and the transferred nucleic acids are stably integrated into the chromosomal DNA of the host. The development of specialized cell lines (termed "packaging cells") which produce only replication-defective retroviruses has increased the utility of retroviruses for gene therapy, and defective retroviruses are characterized for use in gene transfer for gene therapy purposes (for a review see Miller, A. D. (1990) *Blood* 76:27 1). A replication defective retrovirus can be packaged into virions which can be used to infect a target cell through the use of a helper virus by standard techniques. Protocols for producing recombinant retroviruses and for infecting cells in vitro or in vivo with such viruses can be found in Current Protocols in Molecular Biology, Ausubel, F. M. et al., (eds.) Greene Publishing Associates, (1989), Sections 9.10-9.14 and other standard laboratory manuals.

Another viral gene delivery system useful in the present invention uses adenovirus-derived vectors. The genome of an adenovirus can be manipulated such that it encodes and expresses a gene product of interest but is inactivated in terms of its ability to replicate in a normal lytic viral life cycle. See, for example, Berkner et al., *BioTechniques* 6:616 (1988); Rosenfeld et al., Science 252:431-434 (1991); and Rosenfeld et al., *Cell* 68:143-155 (1992). Suitable adenoviral vectors derived from the adenovirus strain Ad type 5 d1324 or other strains of adenovirus (e.g., Ad2, Ad3, Ad7 etc.) are known to those skilled in the art. Recombinant adenoviruses can be advantageous in certain circumstances in that they are not capable of infecting nondividing cells and can be used to infect a wide variety of cell types, including epithelial cells (Rosenfeld et al., (1992) cited supra). Furthermore, the virus particle is relatively stable and amenable to purification and concentration, and as above, can be modified so as to affect the spectrum of infectivity. Additionally, introduced adenoviral DNA (and foreign DNA contained therein) is not integrated into the genome of a host cell but remains episomal, thereby avoiding potential problems that can occur as a result of insertional mutagenesis in situations where introduced DNA becomes integrated into the host genome (e.g., retroviral DNA). Moreover, the carrying capacity of the adenoviral genome for foreign DNA is large (up to 8 kilobases) relative to other gene delivery vectors (Berkner et al., cited supra; Haj-Ahmand et al., J. Virol. 57:267 (1986)).

In another embodiment, non-viral gene delivery systems of the present invention rely on endocytic pathways for the uptake of the subject nucleotide molecule by the targeted cell. Exemplary gene delivery systems of this type include liposomal derived systems, poly-lysine conjugates, and artificial viral envelopes. In a representative embodiment, a nucleic acid molecule encoding an albumin fusion protein of the invention can be entrapped in liposomes bearing positive charges on their surface (e.g., lipofectins) and (optionally) which are tagged with antibodies against cell surface antigens of the target tissue (Mizuno et al. (1992) *No Shinkei Geka* 20:547-5 5 1; PCT publication WO91/06309; Japanese patent application 1047381; and European patent publication EP-A-43075).

Gene delivery systems for a gene encoding an albumin fusion protein of the invention can be introduced into a patient by any of a number of methods. For instance, a pharmaceutical preparation of the gene delivery system can be introduced systemically, e.g. by intravenous injection, and specific transduction of the protein in the target cells occurs predominantly from specificity of transfection provided by the gene delivery vehicle, cell-type or tissue-type expression due to the transcriptional regulatory sequences controlling expression of the receptor gene, or a combination thereof. In other embodiments, initial delivery of the recombinant gene is more limited with introduction into the animal being quite localized. For example, the gene delivery vehicle can be introduced by catheter (see U.S. Pat. No. 5,328,470) or by Stereotactic injection (e.g. Chen et al. (1994) *PNAS* 91: 3 054-3 05 7). The pharmaceutical preparation of the gene therapy construct can consist essentially of the gene delivery system in an acceptable diluent, or can comprise a slow release matrix in which the gene delivery vehicle is imbedded. Where the albumin fusion protein can be produced intact from recombinant cells, e.g. retroviral vectors, the pharmaceutical preparation can comprise one or more cells which produce the albumin fusion protein.

Additional Gene Therapy Methods

Also encompassed by the invention are gene therapy methods for treating or preventing disorders, diseases and conditions. The gene therapy methods relate to the introduction of nucleic acid (DNA, RNA and antisense DNA or RNA) sequences into an animal to achieve expression of an albumin fusion protein of the invention. This method requires a polynucleotide which codes for an albumin fusion protein of the present invention operatively linked to a promoter and any other genetic elements necessary for the expression of the fusion protein by the target tissue. Such gene therapy and delivery techniques are known in the art, see, for example, WO90/11092, which is herein incorporated by reference.

Thus, for example, cells from a patient may be engineered with a polynucleotide (DNA or RNA) comprising a promoter operably linked to a polynucleotide encoding an albumin fusion protein of the present invention ex vivo, with the engineered cells then being provided to a patient to be treated with the fusion protein of the present invention. Such methods are well-known in the art. For example, see Belldegrun, A., et al., J. Natl. Cancer Inst. 85: 207-216 (1993); Ferrantini, M. et al., Cancer Research 53: 1107-1112 (1993); Ferrantini, M. et al., J. Immunology 153: 4604-4615 (1994); Kaido, T., et al., Int. J. Cancer 60: 221-229 (1995); Ogura, H., et al., Cancer Research 50: 5102-5106 (1990); Santodonato, L., et al., Human Gene Therapy 7:1-10 (1996); Santodonato, L., et al., Gene Therapy 4:1246-1255 (1997); and Zhang, J.-F. et al., Cancer Gene Therapy 3: 31-38 (1996)), which are herein incorporated by reference. In one embodiment, the cells which are engineered are arterial cells. The arterial cells may be reintroduced into the patient through direct injection to the artery, the tissues surrounding the artery, or through catheter injection.

As discussed in more detail below, the polynucleotide constructs can be delivered by any method that delivers injectable materials to the cells of an animal, such as, injection into the interstitial space of tissues (heart, muscle, skin, lung, liver, and the like). The polynucleotide constructs may be delivered in a pharmaceutically acceptable liquid or aqueous carrier.

In one embodiment, polynucleotides encoding the albumin fusion proteins of the present invention is delivered as a naked polynucleotide. The term "naked" polynucleotide, DNA or RNA refers to sequences that are free from any delivery vehicle that acts to assist, promote or facilitate entry into the cell, including viral sequences, viral particles, liposome formulations, lipofectin or precipitating agents and the like. However, polynucleotides encoding the albumin fusion proteins of the present invention can also be delivered in liposome formulations and lipofectin formulations and the like can be prepared by methods well known to those skilled in the art. Such methods are described, for example, in U.S. Pat. Nos. 5,593,972, 5,589,466, and 5,580,859, which are herein incorporated by reference.

The polynucleotide vector constructs used in the gene therapy method are preferably constructs that will not integrate into the host genome nor will they contain sequences that allow for replication. Appropriate vectors include pWL-NEO, pSV2CAT, pOG44, pXT1 and pSG available from Stratagene; pSVK3, pBPV, pMSG and pSVL available from Pharmacia; and pEF1/V5, pcDNA3.1, and pRc/CMV2 available from Invitrogen. Other suitable vectors will be readily apparent to the skilled artisan.

Any strong promoter known to those skilled in the art can be used for driving the expression of the polynucleotide sequence. Suitable promoters include adenoviral promoters, such as the adenoviral major late promoter; or heterologous promoters, such as the cytomegalovirus (CMV) promoter; the respiratory syncytial virus (RSV) promoter; inducible promoters, such as the MMT promoter, the metallothionein promoter; heat shock promoters; the albumin promoter; the ApoAI promoter; human globin promoters; viral thymidine kinase promoters, such as the Herpes Simplex thymidine kinase promoter; retroviral LTRs; the b-actin promoter; and human growth hormone promoters. The promoter also may be the native promoter for the gene corresponding to the Therapeutic protein portion of the albumin fusion proteins of the invention.

Unlike other gene therapy techniques, one major advantage of introducing naked nucleic acid sequences into target cells is the transitory nature of the polynucleotide synthesis in the cells. Studies have shown that non-replicating DNA sequences can be introduced into cells to provide production of the desired polypeptide for periods of up to six months.

The polynucleotide construct can be delivered to the interstitial space of tissues within the an animal, including of muscle, skin, brain, lung, liver, spleen, bone marrow, thymus, heart, lymph, blood, bone, cartilage, pancreas, kidney, gall bladder, stomach, intestine, testis, ovary, uterus, rectum, nervous system, eye, gland, and connective tissue. Interstitial space of the tissues comprises the intercellular, fluid, mucopolysaccharide matrix among the reticular fibers of organ tissues, elastic fibers in the walls of vessels or chambers, collagen fibers of fibrous tissues, or that same matrix within connective tissue ensheathing muscle cells or in the lacunae of bone. It is similarly the space occupied by the plasma of the circulation and the lymph fluid of the lymphatic channels. Delivery to the interstitial space of muscle tissue is preferred for the reasons discussed below. They may be conveniently delivered by injection into the tissues comprising these cells. They are preferably delivered to and expressed in persistent, non-dividing cells which are differentiated, although delivery and expression may be achieved in non-differentiated or less completely differentiated cells, such as, for example, stem cells of blood or skin fibroblasts. In vivo muscle cells are particularly competent in their ability to take up and express polynucleotides.

For the naked nucleic acid sequence injection, an effective dosage amount of DNA or RNA will be in the range of from about 0.05 mg/kg body weight to about 50 mg/kg body weight. Preferably the dosage will be from about 0.005 mg/kg to about 20 mg/kg and more preferably from about 0.05 mg/kg to about 5 mg/kg. Of course, as the artisan of ordinary skill will appreciate, this dosage will vary according to the tissue site of injection. The appropriate and effective dosage of nucleic acid sequence can readily be determined by those of ordinary skill in the art and may depend on the condition being treated and the route of administration.

The preferred route of administration is by the parenteral route of injection into the interstitial space of tissues. However, other parenteral routes may also be used, such as, inhalation of an aerosol formulation particularly for delivery to lungs or bronchial tissues, throat or mucous membranes of the nose. In addition, naked DNA constructs can be delivered to arteries during angioplasty by the catheter used in the procedure.

The naked polynucleotides are delivered by any method known in the art, including, but not limited to, direct needle injection at the delivery site, intravenous injection, topical administration, catheter infusion, and so-called "gene guns". These delivery methods are known in the art.

The constructs may also be delivered with delivery vehicles such as viral sequences, viral particles, liposome formulations, lipofectin, precipitating agents, etc. Such methods of delivery are known in the art.

In certain embodiments, the polynucleotide constructs are complexed in a liposome preparation. Liposomal preparations for use in the instant invention include cationic (positively charged), anionic (negatively charged) and neutral preparations. However, cationic liposomes are particularly preferred because a tight charge complex can be formed between the cationic liposome and the polyanionic nucleic acid. Cationic liposomes have been shown to mediate intracellular delivery of plasmid DNA (Felgner et al., Proc. Natl. Acad. Sci. USA (1987) 84:7413-7416, which is herein incorporated by reference); mRNA (Malone et al., Proc. Natl. Acad. Sci. USA (1989) 86:6077-6081, which is herein incorporated by reference); and purified transcription factors (Debs et al., J. Biol. Chem. (1990) 265:10189-10192, which is herein incorporated by reference), in functional form.

Cationic liposomes are readily available. For example, [1-2,3-dioleyloxy)propyl]-N,N,N-triethylammonium (DOTMA) liposomes are particularly useful and are available under the trademark Lipofectin, from GIBCO BRL, Grand Island, N.Y. (See, also, Felgner et al., Proc. Natl. Acad. Sci. USA (1987) 84:7413-7416, which is herein incorporated by reference). Other commercially available liposomes include transfectace (DDAB/DOPE) and DOTAP/DOPE (Boehringer).

Other cationic liposomes can be prepared from readily available materials using techniques well known in the art. See, e.g. PCT Publication No. WO 90/11092 (which is herein incorporated by reference) for a description of the synthesis of DOTAP (1,2-bis(oleoyloxy)-3-(trimethylammonio)propane) liposomes. Preparation of DOTMA liposomes is explained in the literature, see, e.g., P. Felgner et al., Proc. Natl. Acad. Sci. USA 84:7413-7417, which is herein incorporated by reference. Similar methods can be used to prepare liposomes from other cationic lipid materials.

Similarly, anionic and neutral liposomes are readily available, such as from Avanti Polar Lipids (Birmingham, Ala.), or can be easily prepared using readily available materials. Such materials include phosphatidyl, choline, cholesterol, phosphatidyl ethanolamine, dioleoylphosphatidyl choline (DOPC), dioleoylphosphatidyl glycerol (DOPG), dioleoylphoshatidyl ethanolamine (DOPE), among others. These materials can also be mixed with the DOTMA and DOTAP starting materials in appropriate ratios. Methods for making liposomes using these materials are well known in the art.

For example, commercially dioleoylphosphatidyl choline (DOPC), dioleoylphosphatidyl glycerol (DOPG), and dioleoylphosphatidyl ethanolamine (DOPE) can be used in various combinations to make conventional liposomes, with or without the addition of cholesterol. Thus, for example, DOPG/DOPC vesicles can be prepared by drying 50 mg each of DOPG and DOPC under a stream of nitrogen gas into a sonication vial. The sample is placed under a vacuum pump overnight and is hydrated the following day with deionized water. The sample is then sonicated for 2 hours in a capped vial, using a Heat Systems model 350 sonicator equipped with an inverted cup (bath type) probe at the maximum setting while the bath is circulated at 15 degrees celcius. Alternatively, negatively charged vesicles can be prepared without sonication to produce multilamellar vesicles or by extrusion through nucleopore membranes to produce unilamellar vesicles of discrete size. Other methods are known and available to those of skill in the art.

The liposomes can comprise multilamellar vesicles (MLVs), small unilamellar vesicles (SUVs), or large unilamellar vesicles (LUVs), with SUVs being preferred. The various liposome-nucleic acid complexes are prepared using methods well known in the art. See, e.g., Straubinger et al., Methods of Immunology (1983), 101:512-527, which is herein incorporated by reference. For example, MLVs containing nucleic acid can be prepared by depositing a thin film of phospholipid on the walls of a glass tube and subsequently hydrating with a solution of the material to be encapsulated. SUVs are prepared by extended sonication of MLVs to produce a homogeneous population of unilamellar liposomes. The material to be entrapped is added to a suspension of preformed MLVs and then sonicated. When using liposomes containing cationic lipids, the dried lipid film is resuspended in an appropriate solution such as sterile water or an isotonic buffer solution such as 10 mM Tris/NaCl, sonicated, and then the preformed liposomes are mixed directly with the DNA. The liposome and DNA form a very stable complex due to binding of the positively charged liposomes to the cationic DNA. SUVs find use with small nucleic acid fragments. LUVs are prepared by a number of methods, well known in the art. Commonly used methods include $Ca^{2+}$-EDTA chelation (Papahadjopoulos et al., Biochim. Biophys. Acta (1975) 394:483; Wilson et al., Cell 17:77 (1979)); ether injection (Deamer, D. and Bangham, A., Biochim. Biophys. Acta 443: 629 (1976); Ostro et al., Biochem. Biophys. Res. Commun. 76:836 (1977); Fraley et al., Proc. Natl. Acad. Sci. USA 76:3348 (1979)); detergent dialysis (Enoch, H. and Strittmatter, P., Proc. Natl. Acad. Sci. USA 76:145 (1979)); and reverse-phase evaporation (REV) (Fraley et al., J. Biol. Chem. 255:10431 (1980); Szoka, F. and Papahadjopoulos, D., Proc. Natl. Acad. Sci. USA 75:145 (1978); Schaefer-Ridder et al., Science 215:166 (1982)), which are herein incorporated by reference.

Generally, the ratio of DNA to liposomes will be from about 10:1 to about 1:10. Preferably, the ration will be from about 5:1 to about 1:5. More preferably, the ration will be about 3:1 to about 1:3. Still more preferably, the ratio will be about 1:1.

U.S. Pat. No. 5,676,954 (which is herein incorporated by reference) reports on the injection of genetic material, complexed with cationic liposomes carriers, into mice. U.S. Pat. Nos. 4,897,355, 4,946,787, 5,049,386, 5,459,127, 5,589,466, 5,693,622, 5,580,859, 5,703,055, and international publication no. WO 94/9469 (which are herein incorporated by reference) provide cationic lipids for use in transfecting DNA into cells and mammals. U.S. Pat. Nos. 5,589,466, 5,693,622, 5,580,859, 5,703,055, and international publication no. WO 94/9469 provide methods for delivering DNA-cationic lipid complexes to mammals.

In certain embodiments, cells are engineered, ex vivo or in vivo, using a retroviral particle containing RNA which comprises a sequence encoding an albumin fusion protein of the present invention. Retroviruses from which the retroviral plasmid vectors may be derived include, but are not limited to, Moloney Murine Leukemia Virus, spleen necrosis virus, Rous sarcoma Virus, Harvey Sarcoma Virus, avian leukosis virus, gibbon ape leukemia virus, human immunodeficiency virus, Myeloproliferative Sarcoma Virus, and mammary tumor virus.

The retroviral plasmid vector is employed to transduce packaging cell lines to form producer cell lines. Examples of packaging cells which may be transfected include, but are not limited to, the PE501, PA317, R-2, R-AM, PA12, T19-14X, VT-19-17-H2, RCRE, RCRIP, GP+E-86, GP+envAm12, and DAN cell lines as described in Miller, Human Gene Therapy 1:5-14 (1990), which is incorporated herein by reference in its entirety. The vector may transduce the packaging cells through any means known in the art. Such means include, but are not limited to, electroporation, the use of liposomes, and $CaPO_4$ precipitation. In one alternative, the retroviral plasmid vector may be encapsulated into a liposome, or coupled to a lipid, and then administered to a host.

The producer cell line generates infectious retroviral vector particles which include polynucleotide encoding an albumin fusion protein of the present invention. Such retroviral vector particles then may be employed, to transduce eukaryotic cells, either in vitro or in vivo. The transduced eukaryotic cells will express a fusion protein of the present invention.

In certain other embodiments, cells are engineered, ex vivo or in vivo, with polynucleotide contained in an adenovirus vector. Adenovirus can be manipulated such that it encodes and expresses fusion protein of the present invention, and at the same time is inactivated in terms of its ability to replicate in a normal lytic viral life cycle. Adenovirus expression is achieved without integration of the viral DNA into the host cell chromosome, thereby alleviating concerns about insertional mutagenesis. Furthermore, adenoviruses have been used as live enteric vaccines for many years with an excellent safety profile (Schwartz et al. Am. Rev. Respir. Dis. 109:233-238 (1974)). Finally, adenovirus mediated gene transfer has been demonstrated in a number of instances including transfer of alpha-1-antitrypsin and CFTR to the lungs of cotton rats (Rosenfeld, M. A. et al. (1991) Science 252:431-434; Rosenfeld et al., (1992) Cell 68:143-155). Furthermore, extensive studies to attempt to establish adenovirus as a causative agent in human cancer were uniformly negative (Green, M. et al. (1979) Proc. Natl. Acad. Sci. USA 76:6606).

Suitable adenoviral vectors useful in the present invention are described, for example, in Kozarsky and Wilson, Curr. Opin. Genet. Devel. 3:499-503 (1993); Rosenfeld et al., Cell 68:143-155 (1992); Engelhardt et al., Human Genet. Ther. 4:759-769 (1993); Yang et al., Nature Genet. 7:362-369 (1994); Wilson et al., Nature 365:691-692 (1993); and U.S. Pat. No. 5,652,224, which are herein incorporated by reference. For example, the adenovirus vector Ad2 is useful and can be grown in human 293 cells. These cells contain the E1 region of adenovirus and constitutively express E1a and E1b, which complement the defective adenoviruses by providing the products of the genes deleted from the vector. In addition to Ad2, other varieties of adenovirus (e.g., Ad3, Ad5, and Ad7) are also useful in the present invention.

Preferably, the adenoviruses used in the present invention are replication deficient. Replication deficient adenoviruses require the aid of a helper virus and/or packaging cell line to form infectious particles. The resulting virus is capable of infecting cells and can express a polynucleotide of interest which is operably linked to a promoter, but cannot replicate in most cells. Replication deficient adenoviruses may be deleted in one or more of all or a portion of the following genes: E1a, E1b, E3, E4, E2a, or L1 through L5.

In certain other embodiments, the cells are engineered, ex vivo or in vivo, using an adeno-associated virus (AAV). AAVs are naturally occurring defective viruses that require helper viruses to produce infectious particles (Muzyczka, N., Curr. Topics in Microbiol. Immunol. 158:97 (1992)). It is also one of the few viruses that may integrate its DNA into non-dividing cells. Vectors containing as little as 300 base pairs of AAV can be packaged and can integrate, but space for exogenous DNA is limited to about 4.5 kb. Methods for producing and using such AAVs are known in the art. See, for example, U.S. Pat. Nos. 5,139,941, 5,173,414, 5,354,678, 5,436,146, 5,474,935, 5,478,745, and 5,589,377.

For example, an appropriate AAV vector for use in the present invention will include all the sequences necessary for DNA replication, encapsidation, and host-cell integration. The polynucleotide construct is inserted into the AAV vector using standard cloning methods, such as those found in Sambrook et al., Molecular Cloning: A Laboratory Manual, Cold Spring Harbor Press (1989). The recombinant AAV vector is then transfected into packaging cells which are infected with a helper virus, using any standard technique, including lipofection, electroporation, calcium phosphate precipitation, etc. Appropriate helper viruses include adenoviruses, cytomegaloviruses, vaccinia viruses, or herpes viruses. Once the packaging cells are transfected and infected, they will produce infectious AAV viral particles which contain the polynucleotide construct. These viral particles are then used to transduce eukaryotic cells, either ex vivo or in vivo. The transduced cells will contain the polynucleotide construct integrated into its genome, and will express a fusion protein of the invention.

Another method of gene therapy involves operably associating heterologous control regions and endogenous polynucleotide sequences (e.g. encoding a polypeptide of the present invention) via homologous recombination (see, e.g., U.S. Pat. No. 5,641,670, issued Jun. 24, 1997; International Publication No. WO 96/29411, published Sep. 26, 1996; International Publication No. WO 94/12650, published Aug. 4, 1994; Koller et al., Proc. Natl. Acad. Sci. USA 86:8932-8935 (1989); and Zijlstra et al., Nature 342:435-438 (1989), which are herein incorporated by reference. This method involves the activation of a gene which is present in the target cells, but which is not normally expressed in the cells, or is expressed at a lower level than desired.

Polynucleotide constructs are made, using standard techniques known in the art, which contain the promoter with targeting sequences flanking the promoter. Suitable promoters are described herein. The targeting sequence is sufficiently complementary to an endogenous sequence to permit homologous recombination of the promoter-targeting sequence with the endogenous sequence. The targeting sequence will be sufficiently near the 5' end of the desired endogenous polynucleotide sequence so the promoter will be operably linked to the endogenous sequence upon homologous recombination.

The promoter and the targeting sequences can be amplified using PCR. Preferably, the amplified promoter contains distinct restriction enzyme sites on the 5' and 3' ends. Preferably, the 3' end of the first targeting sequence contains the same restriction enzyme site as the 5' end of the amplified promoter and the 5' end of the second targeting sequence contains the same restriction site as the 3' end of the amplified promoter. The amplified promoter and targeting sequences are digested and ligated together.

The promoter-targeting sequence construct is delivered to the cells, either as naked polynucleotide, or in conjunction with transfection-facilitating agents, such as liposomes, viral sequences, viral particles, whole viruses, lipofection, precipitating agents, etc., described in more detail above. The P promoter-targeting sequence can be delivered by any method, included direct needle injection, intravenous injection, topical administration, catheter infusion, particle accelerators, etc. The methods are described in more detail below.

The promoter-targeting sequence construct is taken up by cells. Homologous recombination between the construct and the endogenous sequence takes place, such that an endogenous sequence is placed under the control of the promoter. The promoter then drives the expression of the endogenous sequence.

The polynucleotide encoding an albumin fusion protein of the present invention may contain a secretory signal sequence that facilitates secretion of the protein. Typically, the signal sequence is positioned in the coding region of the polynucleotide to be expressed towards or at the 5' end of the coding region. The signal sequence may be homologous or heterologous to the polynucleotide of interest and may be homologous or heterologous to the cells to be transfected. Additionally, the signal sequence may be chemically synthesized using methods known in the art.

Any mode of administration of any of the above-described polynucleotides constructs can be used so long as the mode results in the expression of one or more molecules in an amount sufficient to provide a therapeutic effect. This includes direct needle injection, systemic injection, catheter infusion, biolistic injectors, particle accelerators (i.e., "gene guns"), gelfoam sponge depots, other commercially available depot materials, osmotic pumps (e.g., Alza minipumps), oral or suppositorial solid (tablet or pill) pharmaceutical formulations, and decanting or topical applications during surgery. For example, direct injection of naked calcium phosphate-precipitated plasmid into rat liver and rat spleen or a protein-coated plasmid into the portal vein has resulted in gene expression of the foreign gene in the rat livers (Kaneda et al., Science 243:375 (1989)).

A preferred method of local administration is by direct injection. Preferably, an albumin fusion protein of the present invention complexed with a delivery vehicle is administered by direct injection into or locally within the area of arteries. Administration of a composition locally within the area of arteries refers to injecting the composition centimeters and preferably, millimeters within arteries.

Another method of local administration is to contact a polynucleotide construct of the present invention in or around a surgical wound. For example, a patient can undergo surgery and the polynucleotide construct can be coated on the surface of tissue inside the wound or the construct can be injected into areas of tissue inside the wound.

Therapeutic compositions useful in systemic administration, include fusion proteins of the present invention complexed to a targeted delivery vehicle of the present invention. Suitable delivery vehicles for use with systemic administration comprise liposomes comprising ligands for targeting the vehicle to a particular site. In specific embodiments, suitable delivery vehicles for use with systemic administration comprise liposomes comprising albumin fusion proteins of the invention for targeting the vehicle to a particular site.

Preferred methods of systemic administration, include intravenous injection, aerosol, oral and percutaneous (topical) delivery. Intravenous injections can be performed using methods standard in the art. Aerosol delivery can also be performed using methods standard in the art (see, for example, Stribling et al., Proc. Natl. Acad. Sci. USA 189: 11277-11281, 1992, which is incorporated herein by reference). Oral delivery can be performed by complexing a polynucleotide construct of the present invention to a carrier capable of withstanding degradation by digestive enzymes in the gut of an animal. Examples of such carriers, include plastic capsules or tablets, such as those known in the art. Topical delivery can be performed by mixing a polynucleotide construct of the present invention with a lipophilic reagent (e.g., DMSO) that is capable of passing into the skin.

Determining an effective amount of substance to be delivered can depend upon a number of factors including, for example, the chemical structure and biological activity of the substance, the age and weight of the animal, the precise condition requiring treatment and its severity, and the route of administration. The frequency of treatments depends upon a number of factors, such as the amount of polynucleotide constructs administered per dose, as well as the health and history of the subject. The precise amount, number of doses, and timing of doses will be determined by the attending physician or veterinarian.

Albumin fusion proteins of the present invention can be administered to any animal, preferably to mammals and birds. Preferred mammals include humans, dogs, cats, mice, rats, rabbits sheep, cattle, horses and pigs, with humans being particularly preferred.

Biological Activities

Albumin fusion proteins and/or polynucleotides encoding albumin fusion proteins of the present invention, can be used in assays to test for one or more biological activities. If an albumin fusion protein and/or polynucleotide exhibits an activity in a particular assay, it is likely that the Therapeutic protein corresponding to the fusion protein may be involved in the diseases associated with the biological activity. Thus, the fusion protein could be used to treat the associated disease.

In preferred embodiments, the present invention encompasses a method of treating a disease or disorder listed in the "Preferred Indication Y" column of Table 1 comprising administering to a patient in which such treatment, prevention or amelioration is desired an albumin fusion protein of the invention that comprises a Therapeutic protein portion corresponding to a Therapeutic protein disclosed in the "Therapeutic Protein X" column of Table 1 (in the same row as the disease or disorder to be treated is listed in the "Preferred Indication Y" column of Table 1) in an amount effective to treat, prevent or ameliorate the disease or disorder.

In a further preferred embodiment, the present invention encompasses a method of treating a disease or disorder listed for a particular Therapeutic protein in the "Preferred Indication:Y" column of Table 1 comprising administering to a patient in which such treatment, prevention or amelioration is desired an albumin fusion protein of the invention that comprises a Therapeutic protein portion corresponding to the Therapeutic protein for which the indications in the Examples are related in an amount effective to treat, prevent or ameliorate the disease or disorder.

Specifically contemplated by the present invention are albumin fusion proteins produced by a cell when encoded by the polynucleotides that encode SEQ ID NO:Y. When these polynucleotides are used to express the encoded protein from a cell, the cell's natural secretion and processing steps produces a protein that lacks the signal sequence explicitly listed in columns 4 and/or 11 of Table 2. The specific amino acid sequence of the listed signal sequence is shown in the specification or is well known in the art. Thus, most preferred embodiments of the present invention include the albumin fusion protein produced by a cell (which would lack the leader sequence shown in columns 4 and/or 11 of Table 2). Also most preferred are polypeptides comprising SEQ ID NO:Y without the specific leader sequence listed in columns 4 and/or 11 of Table 2. Compositions comprising these two preferred embodiments, including pharmaceutical compositions, are also preferred. These albumin fusion proteins are specifically contemplated to treat, prevent, or ameliorate a disease or disorder listed for a particular Therapeutic protein in the "Preferred Indication:Y" column of Table 1.

In preferred embodiments, fusion proteins of the present invention may be used in the diagnosis, prognosis, prevention and/or treatment of diseases and/or disorders relating to diseases and disorders of the endocrine system (see, for example, "Endocrine Disorders" section below), the nervous system (see, for example, "Neurological Disorders" section below), the immune system (see, for example, "Immune Activity" section below), respiratory system (see, for example, "Respiratory Disorders" section below), cardiovascular system (see, for example, "Cardiovascular Disorders" section below), reproductive system (see, for example, "Reproductive System Disorders" section below) digestive system (see, for example, "Gastrointestinal Disorders" section below), diseases and/or disorders relating to cell proliferation (see, for example, "Hyperproliferative Disorders" section below), and/or diseases or disorders relating to the blood (see, for example, "Blood-Related Disorders" section below).

In certain embodiments, an albumin fusion protein of the present invention may be used to diagnose and/or prognose diseases and/or disorders associated with the tissue(s) in which the gene corresponding to the Therapeutic protein portion of the fusion protein of the invention is expressed.

Thus, fusion proteins of the invention and polynucleotides encoding albumin fusion proteins of the invention are useful in the diagnosis, detection and/or treatment of diseases and/or disorders associated with activities that include, but are not limited to, prohormone activation, neurotransmitter activity, cellular signaling, cellular proliferation, cellular differentiation, and cell migration.

More generally, fusion proteins of the invention and polynucleotides encoding albumin fusion proteins of the invention may be useful for the diagnosis, prognosis, prevention and/or treatment of diseases and/or disorders associated with the following systems.

Immune Activity

Albumin fusion proteins of the invention and polynucleotides encoding albumin fusion proteins of the invention may be useful in treating, preventing, diagnosing and/or prognosing diseases, disorders, and/or conditions of the immune system, by, for example, activating or inhibiting the proliferation, differentiation, or mobilization (chemotaxis) of immune cells. Immune cells develop through a process called hematopoiesis, producing myeloid (platelets, red blood cells, neutrophils, and macrophages) and lymphoid (B and T lymphocytes) cells from pluripotent stem cells. The etiology of these immune diseases, disorders, and/or conditions may be genetic, somatic, such as cancer and some autoimmune diseases, acquired (e.g., by chemotherapy or toxins), or infectious. Moreover, fusion proteins of the invention and/or polynucleotides encoding albumin fusion proteins of the invention can be used as a marker or detector of a particular immune system disease or disorder.

In another embodiment, a fusion protein of the invention and/or polynucleotide encoding an albumin fusion protein of the invention, may be used to treat diseases and disorders of the immune system and/or to inhibit or enhance an immune response generated by cells associated with the tissue(s) in which the polypeptide of the invention is expressed.

Albumin fusion proteins of the invention and/or polynucleotides encoding albumin fusion proteins of the invention may be useful in treating, preventing, diagnosing, and/or prognosing immunodeficiencies, including both congenital and acquired immunodeficiencies. Examples of B cell immunodeficiencies in which immunoglobulin levels B cell function and/or B cell numbers are decreased include: X-linked agammaglobulinemia (Bruton's disease), X-linked infantile agammaglobulinemia, X-linked immunodeficiency with hyper IgM, non X-linked immunodeficiency with hyper IgM, X-linked lymphoproliferative syndrome (XLP), agammaglobulinemia including congenital and acquired agammaglobulinemia, adult onset agammaglobulinemia, late-onset agammaglobulinemia, dysgammaglobulinemia, hypogammaglobulinemia, unspecified hypogammaglobulinemia, recessive agammaglobulinemia (Swiss type), Selective IgM deficiency, selective IgA deficiency, selective IgG subclass deficiencies, IgG subclass deficiency (with or without IgA deficiency), Ig deficiency with increased IgM, IgG and IgA deficiency with increased IgM, antibody deficiency with normal or elevated Igs, Ig heavy chain deletions, kappa chain deficiency, B cell lymphoproliferative disorder (BLPD), common variable immunodeficiency (CVID), common variable immunodeficiency (CVI) (acquired), and transient hypogammaglobulinemia of infancy.

In specific embodiments, ataxia-telangiectasia or conditions associated with ataxia-telangiectasia are treated, prevented, diagnosed, and/or prognosing using the, fusion proteins of the invention and/or polynucleotides encoding albumin fusion proteins of the invention.

Examples of congenital immunodeficiencies in which T cell and/or B cell function and/or number is decreased include, but are not limited to: DiGeorge anomaly, severe combined immunodeficiencies (SCID) (including, but not limited to, X-linked SCID, autosomal recessive SCID, adenosine deaminase deficiency, purine nucleoside phosphorylase (PNP) deficiency, Class II MHC deficiency (Bare lymphocyte syndrome), Wiskott-Aldrich syndrome, and ataxia telangiectasia), thymic hypoplasia, third and fourth pharyngeal pouch syndrome, 22q11.2 deletion, chronic mucocutaneous candidiasis, natural killer cell deficiency (NK), idiopathic CD4+ T-lymphocytopenia, immunodeficiency with predominant T cell defect (unspecified), and unspecified immunodeficiency of cell mediated immunity.

In specific embodiments, DiGeorge anomaly or conditions associated with DiGeorge anomaly are treated, prevented, diagnosed, and/or prognosed using fusion proteins of the invention and/or polynucleotides encoding albumin fusion proteins of the invention.

Other immunodeficiencies that may be treated, prevented, diagnosed, and/or prognosed using fusion proteins of the invention and/or polynucleotides encoding albumin fusion proteins of the invention, include, but are not limited to, chronic granulomatous disease, Chediak-Higashi syndrome, myeloperoxidase deficiency, leukocyte glucose-6-phosphate dehydrogenase deficiency, X-linked lymphoproliferative syndrome (XLP), leukocyte adhesion deficiency, complement component deficiencies (including C1, C2, C3, C4, C5, C6, C7, C8 and/or C9 deficiencies), reticular dysgenesis, thymic alymphoplasia-aplasia, immunodeficiency with thymoma, severe congenital leukopenia, dysplasia with immunodeficiency, neonatal neutropenia, short limbed dwarfism, and Nezelof syndrome-combined immunodeficiency with Igs.

In a preferred embodiment, the immunodeficiencies and/or conditions associated with the immunodeficiencies recited above are treated, prevented, diagnosed and/or prognosed using fusion proteins of the invention and/or polynucleotides encoding albumin fusion proteins of the invention.

In a preferred embodiment fusion proteins of the invention and/or polynucleotides encoding albumin fusion proteins of the invention could be used as an agent to boost immunoresponsiveness among immunodeficient individuals. In specific embodiments, fusion proteins of the invention and/or polynucleotides encoding albumin fusion proteins of the invention could be used as an agent to boost immunoresponsiveness among B cell and/or T cell immunodeficient individuals.

The albumin fusion proteins of the invention and/or polynucleotides encoding albumin fusion proteins of the invention may be useful in treating, preventing, diagnosing and/or prognosing autoimmune disorders. Many autoimmune disorders result from inappropriate recognition of self as foreign material by immune cells. This inappropriate recognition results in an immune response leading to the destruction of the host tissue. Therefore, the administration of fusion proteins of the invention and/or polynucleotides encoding albumin fusion proteins of the invention that can inhibit an immune response, particularly the proliferation, differentiation, or chemotaxis of T-cells, may be an effective therapy in preventing autoimmune disorders.

Autoimmune diseases or disorders that may be treated, prevented, diagnosed and/or prognosed by fusion proteins of the invention and/or polynucleotides encoding albumin fusion proteins of the invention include, but are not limited to, one or more of the following: systemic lupus erythematosus, rheumatoid arthritis, ankylosing spondylitis, multiple sclerosis, autoimmune thyroiditis, Hashimoto's thyroiditis, autoimmune hemolytic anemia, hemolytic anemia, thrombocytopenia, autoimmune thrombocytopenia purpura, autoimmune neonatal thrombocytopenia, idiopathic thrombocytopenia purpura, purpura (e.g., Henloch-Scoenlein purpura), autoimmunocytopenia, Goodpasture's syndrome, Pemphigus vulgaris, myasthenia gravis, Grave's disease (hyperthyroidism), and insulin-resistant diabetes mellitus.

Additional disorders that are likely to have an autoimmune component that may be treated, prevented, and/or diagnosed with the albumin fusion proteins of the invention and/or polynucleotides encoding albumin fusion proteins of the invention include, but are not limited to, type II collagen-induced arthritis, antiphospholipid syndrome, dermatitis, allergic encephalomyelitis, myocarditis, relapsing polychondritis, rheumatic heart disease, neuritis, uveitis ophthalmia, polyendocrinopathies, Reiter's Disease, Stiff-Man Syndrome, autoimmune pulmonary inflammation, autism, Guillain-Barre Syndrome, insulin dependent diabetes mellitus, and autoimmune inflammatory eye disorders.

Additional disorders that are likely to have an autoimmune component that may be treated, prevented, diagnosed and/or prognosed with the albumin fusion proteins of the invention and/or polynucleotides encoding albumin fusion proteins of the invention include, but are not limited to, scleroderma with anti-collagen antibodies (often characterized, e.g., by nucleolar and other nuclear antibodies), mixed connective tissue disease (often characterized, e.g., by antibodies to extractable nuclear antigens (e.g., ribonucleoprotein)), polymyositis (often characterized, e.g., by nonhistone ANA), pernicious anemia (often characterized, e.g., by antiparietal cell, microsomes, and intrinsic factor antibodies), idiopathic Addison's disease (often characterized, e.g., by humoral and cell-mediated adrenal cytotoxicity, infertility (often characterized, e.g., by antispermatozoal antibodies), glomerulonephritis (often characterized, e.g., by glomerular basement membrane antibodies or immune complexes), bullous pemphigoid (often characterized, e.g., by IgG and complement in basement membrane), Sjogren's syndrome (often characterized, e.g., by multiple tissue antibodies, and/or a specific nonhistone ANA (SS-B)), diabetes mellitus (often characterized, e.g., by cell-mediated and humoral islet cell antibodies), and adrenergic drug resistance (including adrenergic drug resistance with asthma or cystic fibrosis) (often characterized, e.g., by beta-adrenergic receptor antibodies).

Additional disorders that may have an autoimmune component that may be treated, prevented, diagnosed and/or prognosed with the albumin fusion proteins of the invention and/or polynucleotides encoding albumin fusion proteins of the invention include, but are not limited to, chronic active hepatitis (often characterized, e.g., by smooth muscle antibodies), primary biliary cirrhosis (often characterized, e.g., by mitochondria antibodies), other endocrine gland failure (often characterized, e.g., by specific tissue antibodies in some cases), vitiligo (often characterized, e.g., by melanocyte antibodies), vasculitis (often characterized, e.g., by Ig and complement in vessel walls and/or low serum complement), post-MI (often characterized, e.g., by myocardial antibodies), cardiotomy syndrome (often characterized, e.g., by myocardial antibodies), urticaria (often characterized, e.g., by IgG and IgM antibodies to IgE), atopic dermatitis (often characterized, e.g., by IgG and IgM antibodies to IgE), asthma (often characterized, e.g., by IgG and IgM antibodies to IgE), and many other inflammatory, granulomatous, degenerative, and atrophic disorders.

In a preferred embodiment, the autoimmune diseases and disorders and/or conditions associated with the diseases and disorders recited above are treated, prevented, diagnosed and/or prognosed using for example, fusion proteins of the invention and/or polynucleotides encoding albumin fusion proteins of the invention. In a specific preferred embodiment, rheumatoid arthritis is treated, prevented, and/or diagnosed using fusion proteins of the invention and/or polynucleotides encoding albumin fusion proteins of the invention.

In another specific preferred embodiment, systemic lupus erythematosus is treated, prevented, and/or diagnosed using fusion proteins of the invention and/or polynucleotides encoding albumin fusion proteins of the invention. In another specific preferred embodiment, idiopathic thrombocytopenia purpura is treated, prevented, and/or diagnosed using fusion proteins of the invention and/or polynucleotides encoding albumin fusion proteins of the invention.

In another specific preferred embodiment IgA nephropathy is treated, prevented, and/or diagnosed using fusion proteins of the invention and/or polynucleotides encoding albumin fusion proteins of the invention.

In a preferred embodiment, the autoimmune diseases and disorders and/or conditions associated with the diseases and disorders recited above are treated, prevented, diagnosed and/or prognosed using fusion proteins of the invention and/or polynucleotides encoding albumin fusion proteins of the invention.

In preferred embodiments, fusion proteins of the invention and/or polynucleotides encoding albumin fusion proteins of the invention are used as a immunosuppressive agent(s).

Albumin fusion proteins of the invention and/or polynucleotides encoding albumin fusion proteins of the invention may be useful in treating, preventing, prognosing, and/or diagnosing diseases, disorders, and/or conditions of hematopoietic cells. Albumin fusion proteins of the invention and/or polynucleotides encoding albumin fusion proteins of the invention could be used to increase differentiation and proliferation of hematopoietic cells, including the pluripotent stem cells, in an effort to treat or prevent those diseases, disorders, and/or conditions associated with a decrease in certain (or many) types hematopoietic cells, including but not limited to, leukopenia, neutropenia, anemia, and thrombocytopenia. Alternatively, fusion proteins of the invention and/or polynucleotides encoding albumin fusion proteins of the invention could be used to increase differentiation and proliferation of hematopoietic cells, including the pluripotent stem cells, in an effort to treat or prevent those diseases, disorders, and/or conditions associated with an increase in certain (or many) types of hematopoietic cells, including but not limited to, histiocytosis.

Allergic reactions and conditions, such as asthma (particularly allergic asthma) or other respiratory problems, may also be treated, prevented, diagnosed and/or prognosed using fusion proteins of the invention and/or polynucleotides encoding albumin fusion proteins of the invention. Moreover, these molecules can be used to treat, prevent, prognose, and/or diagnose anaphylaxis, hypersensitivity to an antigenic molecule, or blood group incompatibility.

Additionally, fusion proteins of the invention and/or polynucleotides encoding albumin fusion proteins of the invention, may be used to treat, prevent, diagnose and/or prognose IgE-mediated allergic reactions. Such allergic reactions include, but are not limited to, asthma, rhinitis, and eczema. In specific embodiments, fusion proteins of the invention and/or polynucleotides encoding albumin fusion proteins of the invention may be used to modulate IgE concentrations in vitro or in vivo.

Moreover, fusion proteins of the invention and/or polynucleotides encoding albumin fusion proteins of the invention have uses in the diagnosis, prognosis, prevention, and/or treatment of inflammatory conditions. For example, since fusion proteins of the invention and/or polynucleotides encoding albumin fusion proteins of the invention may inhibit the activation, proliferation and/or differentiation of cells involved in an inflammatory response, these molecules can be used to prevent and/or treat chronic and acute inflammatory conditions. Such inflammatory conditions include, but are not limited to, for example, inflammation associated with infection (e.g., septic shock, sepsis, or systemic inflammatory response syndrome), ischemia-reperfusion injury, endotoxin lethality, complement-mediated hyperacute rejection, nephritis, cytokine or chemokine induced lung injury, inflammatory bowel disease, Crohn's disease, over production of cytokines (e.g., TNF or IL-1.), respiratory disorders (e.g., asthma and allergy); gastrointestinal disorders (e.g., inflammatory bowel disease); cancers (e.g., gastric, ovarian, lung, bladder, liver, and breast); CNS disorders (e.g., multiple sclerosis; ischemic brain injury and/or stroke, traumatic brain injury, neurodegenerative disorders (e.g., Parkinson's disease and Alzheimer's disease); AIDS-related dementia; and prion disease); cardiovascular disorders (e.g., atherosclerosis, myocarditis, cardiovascular disease, and cardiopulmonary bypass complications); as well as many additional diseases, conditions, and disorders that are characterized by inflammation (e.g., hepatitis, rheumatoid arthritis, gout, trauma, pancreatitis, sarcoidosis, dermatitis, renal ischemia-reperfusion injury, Grave's disease, systemic lupus erythematosus, diabetes mellitus, and allogenic transplant rejection).

Because inflammation is a fundamental defense mechanism, inflammatory disorders can effect virtually any tissue of the body. Accordingly, fusion proteins of the invention and/or polynucleotides encoding albumin fusion proteins of the invention, have uses in the treatment of tissue-specific inflammatory disorders, including, but not limited to, adrenalitis, alveolitis, angiocholecystitis, appendicitis, balanitis, blepharitis, bronchitis, bursitis, carditis, cellulitis, cervicitis, cholecystitis, chorditis, cochlitis, colitis, conjunctivitis, cystitis, dermatitis, diverticulitis, encephalitis, endocarditis, esophagitis, eustachitis, fibrositis, folliculitis, gastritis, gastroenteritis, gingivitis, glossitis, hepatosplenitis, keratitis, labyrinthitis, laryngitis, lymphangitis, mastitis, media otitis, meningitis, metritis, mucitis, myocarditis, myosititis, myringitis, nephritis, neuritis, orchitis, osteochondritis, otitis, pericarditis, peritendonitis, peritonitis, pharyngitis, phlebitis, poliomyelitis, prostatitis, pulpitis, retinitis, rhinitis, salpingitis, scleritis, sclerochoroiditis, scrotitis, sinusitis, spondylitis, steatitis, stomatitis, synovitis, syringitis, tendonitis, tonsillitis, urethritis, and vaginitis.

In specific embodiments, fusion proteins of the invention and/or polynucleotides encoding albumin fusion proteins of the invention, are useful to diagnose, prognose, prevent, and/or treat organ transplant rejections and graft-versus-host disease. Organ rejection occurs by host immune cell destruction of the transplanted tissue through an immune response. Similarly, an immune response is also involved in GVHD, but, in this case, the foreign transplanted immune cells destroy the host tissues. Polypeptides, antibodies, or polynucleotides of the invention, and/or agonists or antagonists thereof, that inhibit an immune response, particularly the activation, proliferation, differentiation, or chemotaxis of T-cells, may be an effective therapy in preventing organ rejection or GVHD. In specific embodiments, fusion proteins of the invention and/or polynucleotides encoding albumin fusion proteins of the invention, that inhibit an immune response, particularly the activation, proliferation, differentiation, or chemotaxis of T-cells, may be an effective therapy in preventing experimental allergic and hyperacute xenograft rejection.

In other embodiments, fusion proteins of the invention and/or polynucleotides encoding albumin fusion proteins of the invention, are useful to diagnose, prognose, prevent, and/or treat immune complex diseases, including, but not limited to, serum sickness, post streptococcal glomerulonephritis, polyarteritis nodosa, and immune complex-induced vasculitis.

Albumin fusion proteins of the invention and/or polynucleotides encoding albumin fusion proteins of the invention can be used to treat, detect, and/or prevent infectious agents. For example, by increasing the immune response, particularly increasing the proliferation activation and/or differentiation of B and/or T cells, infectious diseases may be treated, detected, and/or prevented. The immune response may be increased by either enhancing an existing immune response, or by initiating a new immune response. Alternatively, fusion proteins of the invention and/or polynucleotides encoding albumin fusion proteins of the invention may also directly inhibit the infectious agent (refer to section of application listing infectious agents, etc), without necessarily eliciting an immune response.

In another embodiment, albumin fusion proteins of the invention and/or polynucleotides encoding albumin fusion proteins of the invention are used as a vaccine adjuvant that enhances immune responsiveness to an antigen. In a specific embodiment, albumin fusion proteins of the invention and/or polynucleotides encoding albumin fusion proteins of the invention are used as an adjuvant to enhance tumor-specific immune responses.

In another specific embodiment, albumin fusion proteins of the invention and/or polynucleotides encoding albumin fusion proteins of the invention are used as an adjuvant to enhance anti-viral immune responses. Anti-viral immune responses that may be enhanced using the compositions of the invention as an adjuvant, include virus and virus associated diseases or symptoms described herein or otherwise known in the art. In specific embodiments, the compositions of the invention are used as an adjuvant to enhance an immune response to a virus, disease, or symptom selected from the group consisting of: AIDS, meningitis, Dengue, EBV, and hepatitis (e.g., hepatitis B). In another specific embodiment, the compositions of the invention are used as an adjuvant to enhance an immune response to a virus, disease, or symptom selected from the group consisting of: HIV/AIDS, respiratory syncytial virus, Dengue, rotavirus, Japanese B encephalitis, influenza A and B, parainfluenza, measles, cytomegalovirus, rabies, Junin, Chikungunya, Rift Valley Fever, herpes simplex, and yellow fever.

In another specific embodiment, albumin fusion proteins of the invention and/or polynucleotides encoding albumin fusion proteins of the invention are used as an adjuvant to enhance anti-bacterial or anti-fungal immune responses. Anti-bacterial or anti-fungal immune responses that may be enhanced using the compositions of the invention as an adjuvant, include bacteria or fungus and bacteria or fungus associated diseases or symptoms described herein or otherwise known in the art. In specific embodiments, the compositions of the invention are used as an adjuvant to enhance an immune response to a bacteria or fungus, disease, or symptom selected from the group consisting of: tetanus, Diphtheria, botulism, and meningitis type B.

In another specific embodiment, the compositions of the invention are used as an adjuvant to enhance an immune response to a bacteria or fungus, disease, or symptom selected from the group consisting of: *Vibrio cholerae, Mycobacterium leprae, Salmonella typhi, Salmonella paratyphi, Meisseria meningitidis, Streptococcus pneumoniae*, Group B *streptococcus, Shigella* spp., Enterotoxigenic *Escherichia coli*, Enterohemorrhagic *E. coli*, and *Borrelia burgdorferi*.

In another specific embodiment, albumin fusion proteins of the invention and/or polynucleotides encoding albumin fusion proteins of the invention are used as an adjuvant to enhance anti-parasitic immune responses. Anti-parasitic immune responses that may be enhanced using the compositions of the invention as an adjuvant, include parasite and parasite associated diseases or symptoms described herein or otherwise known in the art. In specific embodiments, the compositions of the invention are used as an adjuvant to enhance an immune response to a parasite. In another specific embodiment, the compositions of the invention are used as an adjuvant to enhance an immune response to *Plasmodium* (malaria) or *Leishmania*.

In another specific embodiment, albumin fusion proteins of the invention and/or polynucleotides encoding albumin fusion proteins of the invention may also be employed to treat infectious diseases including silicosis, sarcoidosis, and idiopathic pulmonary fibrosis; for example, by preventing the recruitment and activation of mononuclear phagocytes.

In another specific embodiment, albumin fusion proteins of the invention and/or polynucleotides encoding albumin fusion proteins of the invention are used as an antigen for the generation of antibodies to inhibit or enhance immune mediated responses against polypeptides of the invention.

In one embodiment, albumin fusion proteins of the invention and/or polynucleotides encoding albumin fusion proteins of the invention are administered to an animal (e.g., mouse, rat, rabbit, hamster, guinea pig, pigs, micro-pig, chicken, camel, goat, horse, cow, sheep, dog, cat, non-human primate, and human, most preferably human) to boost the immune system to produce increased quantities of one or more antibodies (e.g., IgG, IgA, IgM, and IgE), to induce higher affinity antibody production and immunoglobulin class switching (e.g., IgG, IgA, IgM, and IgE), and/or to increase an immune response.

In another specific embodiment, albumin fusion proteins of the invention and/or polynucleotides encoding albumin fusion proteins of the invention are used as a stimulator of B cell responsiveness to pathogens.

In another specific embodiment, albumin fusion proteins of the invention and/or polynucleotides encoding albumin fusion proteins of the invention are used as an activator of T cells.

In another specific embodiment, albumin fusion proteins of the invention and/or polynucleotides encoding albumin fusion proteins of the invention are used as an agent that elevates the immune status of an individual prior to their receipt of immunosuppressive therapies.

In another specific embodiment, albumin fusion proteins of the invention and/or polynucleotides encoding albumin fusion proteins of the invention are used as an agent to induce higher affinity antibodies.

In another specific embodiment, albumin fusion proteins of the invention and/or polynucleotides encoding albumin fusion proteins of the invention are used as an agent to increase serum immunoglobulin concentrations.

In another specific embodiment, albumin fusion proteins of the invention and/or polynucleotides encoding albumin fusion proteins of the invention are used as an agent to accelerate recovery of immunocompromised individuals.

In another specific embodiment, albumin fusion proteins of the invention and/or polynucleotides encoding albumin fusion proteins of the invention are used as an agent to boost immunoresponsiveness among aged populations and/or neonates.

In another specific embodiment, albumin fusion proteins of the invention and/or polynucleotides encoding albumin fusion proteins of the invention are used as an immune system enhancer prior to, during, or after bone marrow transplant and/or other transplants (e.g., allogeneic or xenogeneic organ transplantation). With respect to transplantation, compositions of the invention may be administered prior to, concomitant with, and/or after transplantation. In a specific embodiment, compositions of the invention are administered after transplantation, prior to the beginning of recovery of T-cell populations. In another specific embodiment, compositions of the invention are first administered after transplantation after the beginning of recovery of T cell populations, but prior to full recovery of B cell populations.

In another specific embodiment, albumin fusion proteins of the invention and/or polynucleotides encoding albumin fusion proteins of the invention are used as an agent to boost immunoresponsiveness among individuals having an acquired loss of B cell function. Conditions resulting in an acquired loss of B cell function that may be ameliorated or treated by administering the albumin fusion proteins of the invention and/or polynucleotides encoding albumin fusion proteins of the invention, include, but are not limited to, HIV Infection, AIDS, bone marrow transplant, and B cell chronic lymphocytic leukemia (CLL).

In another specific embodiment, albumin fusion proteins of the invention and/or polynucleotides encoding albumin fusion proteins of the invention are used as an agent to boost immunoresponsiveness among individuals having a temporary immune deficiency. Conditions resulting in a temporary immune deficiency that may be ameliorated or treated by administering the albumin fusion proteins of the invention and/or polynucleotides encoding albumin fusion proteins of the invention, include, but are not limited to, recovery from viral infections (e.g., influenza), conditions associated with malnutrition, recovery from infectious mononucleosis, or conditions associated with stress, recovery from measles, recovery from blood transfusion, and recovery from surgery.

In another specific embodiment, albumin fusion proteins of the invention and/or polynucleotides encoding albumin fusion proteins of the invention are used as a regulator of antigen presentation by monocytes, dendritic cells, and/or B-cells. In one embodiment, albumin fusion proteins of the invention and/or polynucleotides encoding albumin fusion proteins of the invention enhance antigen presentation or antagonize antigen presentation in vitro or in vivo. Moreover, in related embodiments, this enhancement or antagonism of antigen presentation may be useful as an anti-tumor treatment or to modulate the immune system.

In another specific embodiment, albumin fusion proteins of the invention and/or polynucleotides encoding albumin fusion proteins of the invention are used as an agent to direct an individual's immune system towards development of a humoral response (i.e. TH2) as opposed to a TH1 cellular response.

In another specific embodiment, albumin fusion proteins of the invention and/or polynucleotides encoding albumin fusion proteins of the invention are used as a means to induce tumor proliferation and thus make it more susceptible to anti-neoplastic agents. For example, multiple myeloma is a slowly dividing disease and is thus refractory to virtually all anti-neoplastic regimens. If these cells were forced to proliferate more rapidly their susceptibility profile would likely change.

In another specific embodiment, albumin fusion proteins of the invention and/or polynucleotides encoding albumin fusion proteins of the invention are used as a stimulator of B cell production in pathologies such as AIDS, chronic lymphocyte disorder and/or Common Variable Immunodificiency.

In another specific embodiment, albumin fusion proteins of the invention and/or polynucleotides encoding albumin fusion proteins of the invention are used as a therapy for generation and/or regeneration of lymphoid tissues following surgery, trauma or genetic defect. In another specific embodiment, albumin fusion proteins of the invention and/or polynucleotides encoding albumin fusion proteins of the invention are used in the pretreatment of bone marrow samples prior to transplant.

In another specific embodiment, albumin fusion proteins of the invention and/or polynucleotides encoding albumin fusion proteins of the invention are used as a gene-based therapy for genetically inherited disorders resulting in immuno-incompetence/immunodeficiency such as observed among SCID patients.

In another specific embodiment, albumin fusion proteins of the invention and/or polynucleotides encoding albumin fusion proteins of the invention are used as a means of activating monocytes/macrophages to defend against parasitic diseases that effect monocytes such as *Leishmania*.

In another specific embodiment, albumin fusion proteins of the invention and/or polynucleotides encoding albumin fusion proteins of the invention are used as a means of regulating secreted cytokines that are elicited by polypeptides of the invention.

In another embodiment, albumin fusion proteins of the invention and/or polynucleotides encoding albumin fusion proteins of the invention are used in one or more of the applications described herein, as they may apply to veterinary medicine.

In another specific embodiment, albumin fusion proteins of the invention and/or polynucleotides encoding albumin fusion proteins of the invention are used as a means of blocking various aspects of immune responses to foreign agents or self. Examples of diseases or conditions in which blocking of certain aspects of immune responses may be desired include autoimmune disorders such as lupus, and arthritis, as well as immunoresponsiveness to skin allergies, inflammation, bowel disease, injury and diseases/disorders associated with pathogens.

In another specific embodiment, albumin fusion proteins of the invention and/or polynucleotides encoding albumin fusion proteins of the invention are used as a therapy for preventing the B cell proliferation and Ig secretion associated with autoimmune diseases such as idiopathic thrombocytopenic purpura, systemic lupus erythematosus and multiple sclerosis.

In another specific embodiment, polypeptides, antibodies, polynucleotides and/or agonists or antagonists of the present fusion proteins of the invention and/or polynucleotides encoding albumin fusion proteins of the invention invention are used as a inhibitor of B and/or T cell migration in endothelial cells. This activity disrupts tissue architecture or cognate responses and is useful, for example in disrupting immune responses, and blocking sepsis.

In another specific embodiment, albumin fusion proteins of the invention and/or polynucleotides encoding albumin fusion proteins of the invention are used as a therapy for chronic hypergammaglobulinemia evident in such diseases as monoclonal gammopathy of undetermined significance (MGUS), Waldenstrom's disease, related idiopathic monoclonal gammopathies, and plasmacytomas.

In another specific embodiment, albumin fusion proteins of the invention and/or polynucleotides encoding albumin fusion proteins of the invention may be employed for instance to inhibit polypeptide chemotaxis and activation of macrophages and their precursors, and of neutrophils, basophils, B lymphocytes and some T-cell subsets, e.g., activated and CD8 cytotoxic T cells and natural killer cells, in certain autoimmune and chronic inflammatory and infective diseases. Examples of autoimmune diseases are described herein and include multiple sclerosis, and insulin-dependent diabetes.

The albumin fusion proteins of the invention and/or polynucleotides encoding albumin fusion proteins of the invention may also be employed to treat idiopathic hyper-eosinophilic syndrome by, for example, preventing eosinophil production and migration.

In another specific embodiment, albumin fusion proteins of the invention and/or polynucleotides encoding albumin fusion proteins of the invention are used to enhance or inhibit complement mediated cell lysis.

In another specific embodiment, albumin fusion proteins of the invention and/or polynucleotides encoding albumin fusion proteins of the invention are used to enhance or inhibit antibody dependent cellular cytotoxicity.

In another specific embodiment, albumin fusion proteins of the invention and/or polynucleotides encoding albumin fusion proteins of the invention may also be employed for treating atherosclerosis, for example, by preventing monocyte infiltration in the artery wall.

In another specific embodiment, albumin fusion proteins of the invention and/or polynucleotides encoding albumin fusion proteins of the invention may be employed to treat adult respiratory distress syndrome (ARDS).

In another specific embodiment, albumin fusion proteins of the invention and/or polynucleotides encoding albumin fusion proteins of the invention may be useful for stimulating wound and tissue repair, stimulating angiogenesis, and/or stimulating the repair of vascular or lymphatic diseases or disorders. Additionally, fusion proteins of the invention and/or polynucleotides encoding albumin fusion proteins of the invention may be used to stimulate the regeneration of mucosal surfaces.

In a specific embodiment, albumin fusion proteins of the invention and/or polynucleotides encoding albumin fusion proteins of the invention are used to diagnose, prognose, treat, and/or prevent a disorder characterized by primary or acquired immunodeficiency, deficient serum immunoglobulin production, recurrent infections, and/or immune system dysfunction. Moreover, fusion proteins of the invention and/or polynucleotides encoding albumin fusion proteins of the invention may be used to treat or prevent infections of the joints, bones, skin, and/or parotid glands, blood-borne infections (e.g., sepsis, meningitis, septic arthritis, and/or osteomyelitis), autoimmune diseases (e.g., those disclosed herein), inflammatory disorders, and malignancies, and/or any disease or disorder or condition associated with these infections, diseases, disorders and/or malignancies) including, but not limited to, CVID, other primary immune deficiencies, HIV disease, CLL, recurrent bronchitis, sinusitis, otitis media, conjunctivitis, pneumonia, hepatitis, meningitis, herpes zoster (e.g., severe herpes zoster), and/or *pneumocystis carnii*. Other diseases and disorders that may be prevented, diagnosed, prognosed, and/or treated with fusion proteins of the invention and/or polynucleotides encoding albumin fusion proteins of the invention include, but are not limited to, HIV infection, HTLV-BLV infection, lymphopenia, phagocyte bactericidal dysfunction anemia, thrombocytopenia, and hemoglobinuria.

In another embodiment, albumin fusion proteins of the invention and/or polynucleotides encoding albumin fusion proteins of the invention are used to treat, and/or diagnose an individual having common variable immunodeficiency disease ("CVID"; also known as "acquired agammaglobulinemia" and "acquired hypogammaglobulinemia") or a subset of this disease.

In a specific embodiment, albumin fusion proteins of the invention and/or polynucleotides encoding albumin fusion proteins of the invention may be used to diagnose, prognose, prevent, and/or treat cancers or neoplasms including immune cell or immune tissue-related cancers or neoplasms. Examples of cancers or neoplasms that may be prevented, diagnosed, or treated by fusion proteins of the invention and/or polynucleotides encoding albumin fusion proteins of the invention include, but are not limited to, acute myelogenous leukemia, chronic myelogenous leukemia, Hodgkin's disease, non-Hodgkin's lymphoma, acute lymphocytic anemia (ALL) Chronic lymphocyte leukemia, plasmacytomas, multiple myeloma, Burkitt's lymphoma, EBV-transformed diseases, and/or diseases and disorders described in the section entitled "Hyperproliferative Disorders" elsewhere herein.

In another specific embodiment, albumin fusion proteins of the invention and/or polynucleotides encoding albumin fusion proteins of the invention are used as a therapy for decreasing cellular proliferation of Large B-cell Lymphomas.

In another specific embodiment, albumin fusion proteins of the invention and/or polynucleotides encoding albumin fusion proteins of the invention are used as a means of decreasing the involvement of B cells and Ig associated with Chronic Myelogenous Leukemia.

In specific embodiments, the compositions of the invention are used as an agent to boost immunoresponsiveness among B cell immunodeficient individuals, such as, for example, an individual who has undergone a partial or complete splenectomy.

Blood-Related Disorders

The albumin fusion proteins of the invention and/or polynucleotides encoding albumin fusion proteins of the invention may be used to modulate hemostatic (the stopping of bleeding) or thrombolytic (clot dissolving) activity. For example, by increasing hemostatic or thrombolytic activity, fusion proteins of the invention and/or polynucleotides encoding albumin fusion proteins of the invention could be used to treat or prevent blood coagulation diseases, disorders, and/or conditions (e.g., afibrinogenemia, factor deficiencies, hemophilia), blood platelet diseases, disorders, and/or conditions (e.g., thrombocytopenia), or wounds resulting from trauma, surgery, or other causes. Alternatively, fusion proteins of the invention and/or polynucleotides encoding albumin fusion proteins of the invention that can decrease hemostatic or thrombolytic activity could be used to inhibit or dissolve clotting. These molecules could be important in the treatment or prevention of heart attacks (infarction), strokes, or scarring.

In specific embodiments, the albumin fusion proteins of the invention and/or polynucleotides encoding albumin fusion proteins of the invention may be used to prevent, diagnose, prognose, and/or treat thrombosis, arterial thrombosis, venous thrombosis, thromboembolism, pulmonary embolism, atherosclerosis, myocardial infarction, transient ischemic attack, unstable angina. In specific embodiments, the albumin fusion proteins of the invention and/or polynucleotides encoding albumin fusion proteins of the invention may be used for the prevention of occlusion of saphenous grafts, for reducing the risk of periprocedural thrombosis as might accompany angioplasty procedures, for reducing the risk of stroke in patients with atrial fibrillation including nonrheumatic atrial fibrillation, for reducing the risk of embolism associated with mechanical heart valves and or mitral valves disease. Other uses for the albumin fusion proteins of the invention and/or polynucleotides encoding albumin fusion proteins of the invention, include, but are not limited to, the prevention of occlusions in extracorporeal devices (e.g., intravascular canulas, vascular access shunts in hemodialysis patients, hemodialysis machines, and cardiopulmonary bypass machines).

In another embodiment, albumin fusion proteins of the invention and/or polynucleotides encoding albumin fusion proteins of the invention, may be used to prevent, diagnose, prognose, and/or treat diseases and disorders of the blood and/or blood forming organs associated with the tissue(s) in which the polypeptide of the invention is expressed.

The fusion proteins of the invention and/or polynucleotides encoding albumin fusion proteins of the invention may be used to modulate hematopoietic activity (the formation of blood cells). For example, the albumin fusion proteins of the invention and/or polynucleotides encoding albumin fusion proteins of the invention may be used to increase the quantity of all or subsets of blood cells, such as, for example, erythrocytes, lymphocytes (B or T cells), myeloid cells (e.g., basophils, eosinophils, neutrophils, mast cells, macrophages) and platelets. The ability to decrease the quantity of blood cells or subsets of blood cells may be useful in the prevention, detection, diagnosis and/or treatment of anemias and leukopenias described below. Alternatively, the albumin fusion proteins of the invention and/or polynucleotides encoding albumin fusion proteins of the invention may be used to decrease the quantity of all or subsets of blood cells, such as, for example, erythrocytes, lymphocytes (B or T cells), myeloid cells (e.g., basophils, eosinophils, neutrophils, mast cells, macrophages) and platelets. The ability to decrease the quantity of blood cells or subsets of blood cells may be useful in the prevention, detection, diagnosis and/or treatment of leukocytoses, such as, for example eosinophilia.

The fusion proteins of the invention and/or polynucleotides encoding albumin fusion proteins of the invention may be used to prevent, treat, or diagnose blood dyscrasia.

Anemias are conditions in which the number of red blood cells or amount of hemoglobin (the protein that carries oxygen) in them is below normal. Anemia may be caused by excessive bleeding, decreased red blood cell production, or increased red blood cell destruction (hemolysis). The albumin fusion proteins of the invention and/or polynucleotides encoding albumin fusion proteins of the invention may be useful in treating, preventing, and/or diagnosing anemias. Anemias that may be treated prevented or diagnosed by the albumin fusion proteins of the invention and/or polynucleotides encoding albumin fusion proteins of the invention include iron deficiency anemia, hypochromic anemia, microcytic anemia, chlorosis, hereditary siderob; astic anemia, idiopathic acquired sideroblastic anemia, red cell aplasia, megaloblastic anemia (e.g., pernicious anemia, (vitamin B12 deficiency) and folic acid deficiency anemia), aplastic anemia, hemolytic anemias (e.g., autoimmune helolytic anemia, microangiopathic hemolytic anemia, and paroxysmal nocturnal hemoglobinuria). The albumin fusion proteins of the invention and/or polynucleotides encoding albumin fusion proteins of the invention may be useful in treating, preventing, and/or diagnosing anemias associated with diseases including but not limited to, anemias associated with systemic lupus erythematosus, cancers, lymphomas, chronic renal disease, and enlarged spleens. The albumin fusion proteins of the invention and/or polynucleotides encoding albumin fusion proteins of the invention may be useful in treating, preventing, and/or diagnosing anemias arising from drug treatments such as anemias associated with methyldopa, dapsone, and/or sulfadrugs. Additionally, fusion proteins of the invention and/or polynucleotides encoding albumin fusion proteins of the invention may be useful in treating, preventing, and/or diagnosing anemias associated with abnormal red blood cell architecture including but not limited to, hereditary spherocytosis, hereditary elliptocytosis, glucose-6-phosphate dehydrogenase deficiency, and sickle cell anemia.

The albumin fusion proteins of the invention and/or polynucleotides encoding albumin fusion proteins of the invention may be useful in treating, preventing, and/or diagnosing hemoglobin abnormalities, (e.g., those associated with sickle cell anemia, hemoglobin C disease, hemoglobin S-C disease, and hemoglobin E disease). Additionally, the albumin fusion proteins of the invention and/or polynucleotides encoding albumin fusion proteins of the invention may be useful in diagnosing, prognosing, preventing, and/or treating thalassemias, including, but not limited to, major and minor forms of alpha-thalassemia and beta-thalassemia.

In another embodiment, the albumin fusion proteins of the invention and/or polynucleotides encoding albumin fusion proteins of the invention may be useful in diagnosing, prognosing, preventing, and/or treating bleeding disorders including, but not limited to, thrombocytopenia (e.g., idiopathic thrombocytopenic purpura, and thrombotic thrombocytopenic purpura), Von Willebrand's disease, hereditary platelet disorders (e.g., storage pool disease such as Chediak-Higashi and Hermansky-Pudlak syndromes, thromboxane A2 dysfunction, thromboasthenia, and Bernard-Soulier syndrome), hemolytic-uremic syndrome, hemophelias such as hemophelia A or Factor VII deficiency and Christmas disease or Factor IX deficiency, Hereditary Hemorhhagic Telangiectsia, also known as Rendu-Osler-Weber syndrome, allergic purpura (Henoch Schonlein purpura) and disseminated intravascular coagulation.

The effect of the albumin fusion proteins of the invention and/or polynucleotides encoding albumin fusion proteins of the invention on the clotting time of blood may be monitored using any of the clotting tests known in the art including, but not limited to, whole blood partial thromboplastin time (PTT), the activated partial thromboplastin time (aPTT), the activated clotting time (ACT), the recalcified activated clotting time, or the Lee-White Clotting time.

Several diseases and a variety of drugs can cause platelet dysfunction. Thus, in a specific embodiment, the albumin fusion proteins of the invention and/or polynucleotides encoding albumin fusion proteins of the invention may be useful in diagnosing, prognosing, preventing, and/or treating acquired platelet dysfunction such as platelet dysfunction accompanying kidney failure, leukemia, multiple myeloma, cirrhosis of the liver, and systemic lupus erythematosus as well as platelet dysfunction associated with drug treatments, including treatment with aspirin, ticlopidine, nonsteroidal anti-inflammatory drugs (used for arthritis, pain, and sprains), and penicillin in high doses.

In another embodiment, the albumin fusion proteins of the invention and/or polynucleotides encoding albumin fusion proteins of the invention may be useful in diagnosing, prognosing, preventing, and/or treating diseases and disorders characterized by or associated with increased or decreased numbers of white blood cells. Leukopenia occurs when the number of white blood cells decreases below normal. Leukopenias include, but are not limited to, neutropenia and lymphocytopenia. An increase in the number of white blood cells compared to normal is known as leukocytosis. The body generates increased numbers of white blood cells during infection. Thus, leukocytosis may simply be a normal physiological parameter that reflects infection. Alternatively, leukocytosis may be an indicator of injury or other disease such as cancer. Leokocytoses, include but are not limited to, eosinophilia, and accumulations of macrophages. In specific embodiments, the albumin fusion proteins of the invention and/or polynucleotides encoding albumin fusion proteins of the invention may be useful in diagnosing, prognosing, preventing, and/or treating leukopenia. In other specific embodiments, the albumin fusion proteins of the invention and/or polynucleotides encoding albumin fusion proteins of the invention may be useful in diagnosing, prognosing, preventing, and/or treating leukocytosis.

Leukopenia may be a generalized decreased in all types of white blood cells, or may be a specific depletion of particular types of white blood cells. Thus, in specific embodiments, the albumin fusion proteins of the invention and/or polynucleotides encoding albumin fusion proteins of the invention may be useful in diagnosing, prognosing, preventing, and/or treating decreases in neutrophil numbers, known as neutropenia. Neutropenias that may be diagnosed, prognosed, prevented, and/or treated by the albumin fusion proteins of the invention and/or polynucleotides encoding albumin fusion proteins of the invention include, but are not limited to, infantile genetic agranulocytosis, familial neutropenia, cyclic neutropenia, neutropenias resulting from or associated with dietary deficiencies (e.g., vitamin B 12 deficiency or folic acid deficiency), neutropenias resulting from or associated with drug treatments (e.g., antibiotic regimens such as penicillin treatment, sulfonamide treatment, anticoagulant treatment, anticonvulsant drugs, anti-thyroid drugs, and cancer chemotherapy), and neutropenias resulting from increased neutrophil destruction that may occur in association with some bacterial or viral infections, allergic disorders, autoimmune diseases, conditions in which an individual has an enlarged spleen (e.g., Felty syndrome, malaria and sarcoidosis), and some drug treatment regimens.

The albumin fusion proteins of the invention and/or polynucleotides encoding albumin fusion proteins of the invention may be useful in diagnosing, prognosing, preventing, and/or treating lymphocytopenias (decreased numbers of B and/or T lymphocytes), including, but not limited to, lymphocytopenias resulting from or associated with stress, drug treatments (e.g., drug treatment with corticosteroids, cancer chemotherapies, and/or radiation therapies), AIDS infection and/or other diseases such as, for example, cancer, rheumatoid arthritis, systemic lupus erythematosus, chronic infections, some viral infections and/or hereditary disorders (e.g., DiGeorge syndrome, Wiskott-Aldrich Syndome, severe combined immunodeficiency, ataxia telangiectsia).

The albumin fusion proteins of the invention and/or polynucleotides encoding albumin fusion proteins of the invention may be useful in diagnosing, prognosing, preventing, and/or treating diseases and disorders associated with macrophage numbers and/or macrophage function including, but not limited to, Gaucher's disease, Niemann-Pick disease, Letterer-Siwe disease and Hand-Schuller-Christian disease.

In another embodiment, the albumin fusion proteins of the invention and/or polynucleotides encoding albumin fusion proteins of the invention may be useful in diagnosing, prognosing, preventing, and/or treating diseases and disorders associated with eosinophil numbers and/or eosinophil function including, but not limited to, idiopathic hypereosinophilic syndrome, eosinophilia-myalgia syndrome, and Hand-Schuller-Christian disease.

In yet another embodiment, the albumin fusion proteins of the invention and/or polynucleotides encoding albumin fusion proteins of the invention may be useful in diagnosing, prognosing, preventing, and/or treating leukemias and lymphomas including, but not limited to, acute lymphocytic (lymphpblastic) leukemia (ALL), acute myeloid (myelocytic, myelogenous, myeloblastic, or myelomonocytic) leukemia, chronic lymphocytic leukemia (e.g., B cell leukemias, T cell leukemias, Sezary syndrome, and Hairy cell leukenia), chronic myelocytic (myeloid, myelogenous, or granulocytic) leukemia, Hodgkin's lymphoma, non-hodgkin's lymphoma, Burkitt's lymphoma, and mycosis fungoides.

In other embodiments, the albumin fusion proteins of the invention and/or polynucleotides encoding albumin fusion proteins of the invention may be useful in diagnosing, prognosing, preventing, and/or treating diseases and disorders of plasma cells including, but not limited to, plasma cell dyscrasias, monoclonal gammaopathies, monoclonal gammopathies of undetermined significance, multiple myeloma, macroglobulinemia, Waldenstrom's macroglobulinemia, cryoglobulinemia, and Raynaud's phenomenon.

In other embodiments, the albumin fusion proteins of the invention and/or polynucleotides encoding albumin fusion proteins of the invention may be useful in treating, preventing, and/or diagnosing myeloproliferative disorders, including but not limited to, polycythemia vera, relative polycythemia, secondary polycythemia, myelofibrosis, acute myelofibrosis, agnogenic myelod metaplasia, thrombocythemia, (including both primary and seconday thrombocythemia) and chronic myelocytic leukemia.

In other embodiments, the albumin fusion proteins of the invention and/or polynucleotides encoding albumin fusion proteins of the invention may be useful as a treatment prior to surgery, to increase blood cell production.

In other embodiments, the albumin fusion proteins of the invention and/or polynucleotides encoding albumin fusion proteins of the invention may be useful as an agent to enhance the migration, phagocytosis, superoxide production, antibody dependent cellular cytotoxicity of neutrophils, eosionophils and macrophages.

In other embodiments, the albumin fusion proteins of the invention and/or polynucleotides encoding albumin fusion proteins of the invention may be useful as an agent to increase the number of stem cells in circulation prior to stem cells pheresis. In another specific embodiment, the albumin fusion proteins of the invention and/or polynucleotides encoding albumin fusion proteins of the invention may be useful as an agent to increase the number of stem cells in circulation prior to platelet pheresis.

In other embodiments, the albumin fusion proteins of the invention and/or polynucleotides encoding albumin fusion proteins of the invention may be useful as an agent to increase cytokine production.

In other embodiments, the albumin fusion proteins of the invention and/or polynucleotides encoding albumin fusion proteins of the invention may be useful in preventing, diagnosing, and/or treating primary hematopoietic disorders.

Hyperproliferative Disorders

In certain embodiments, fusion proteins of the invention and/or polynucleotides encoding albumin fusion proteins of the invention can be used to treat or detect hyperproliferative disorders, including neoplasms. Albumin fusion proteins of the invention and/or polynucleotides encoding albumin fusion proteins of the invention may inhibit the proliferation of the disorder through direct or indirect interactions. Alternatively, fusion proteins of the invention and/or polynucleotides encoding albumin fusion proteins of the invention may proliferate other cells which can inhibit the hyperproliferative disorder.

For example, by increasing an immune response, particularly increasing antigenic qualities of the hyperproliferative disorder or by proliferating, differentiating, or mobilizing T-cells, hyperproliferative disorders can be treated. This immune response may be increased by either enhancing an existing immune response, or by initiating a new immune response. Alternatively, decreasing an immune response may also be a method of treating hyperproliferative disorders, such as a chemotherapeutic agent.

Examples of hyperproliferative disorders that can be treated or detected by fusion proteins of the invention and/or polynucleotides encoding albumin fusion proteins of the invention include, but are not limited to neoplasms located in the: colon, abdomen, bone, breast, digestive system, liver, pancreas, peritoneum, endocrine glands (adrenal, parathyroid, pituitary, testicles, ovary, thymus, thyroid), eye, head and neck, nervous (central and peripheral), lymphatic system, pelvis, skin, soft tissue, spleen, thorax, and urogenital tract.

Similarly, other hyperproliferative disorders can also be treated or detected by fusion proteins of the invention and/or polynucleotides encoding albumin fusion proteins of the invention. Examples of such hyperproliferative disorders include, but are not limited to: Acute Childhood Lymphoblastic Leukemia, Acute Lymphoblastic Leukemia, Acute Lymphocytic Leukemia, Acute Myeloid Leukemia, Adrenocortical Carcinoma, Adult (Primary) Hepatocellular Cancer, Adult (Primary) Liver Cancer, Adult Acute Lymphocytic Leukemia, Adult Acute Myeloid Leukemia, Adult Hodgkin's Disease, Adult Hodgkin's Lymphoma, Adult Lymphocytic Leukemia, Adult Non-Hodgkin's Lymphoma, Adult Primary Liver Cancer, Adult Soft Tissue Sarcoma, AIDS-Related Lymphoma, AIDS-Related Malignancies, Anal Cancer, Astrocytoma, Bile Duct Cancer, Bladder Cancer, Bone Cancer, Brain Stem Glioma, Brain Tumors, Breast Cancer, Cancer of the Renal Pelvis and Ureter, Central Nervous System (Primary) Lymphoma, Central Nervous System Lymphoma, Cerebellar Astrocytoma, Cerebral Astrocytoma, Cervical Cancer, Childhood (Primary) Hepatocellular Cancer, Childhood (Primary) Liver Cancer, Childhood Acute Lymphoblastic Leukemia, Childhood Acute Myeloid Leukemia, Childhood Brain Stem Glioma, Childhood Cerebellar Astrocytoma, Childhood Cerebral Astrocytoma, Childhood Extracranial Germ Cell Tumors, Childhood Hodgkin's Disease, Childhood Hodgkin's Lymphoma, Childhood Hypothalamic and Visual Pathway Glioma, Childhood Lymphoblastic Leukemia, Childhood Medulloblastoma, Childhood Non-Hodgkin's Lymphoma, Childhood Pineal and Supratentorial Primitive Neuroectodermal Tumors, Childhood Primary Liver Cancer, Childhood Rhabdomyosarcoma, Childhood Soft Tissue Sarcoma, Childhood Visual Pathway and Hypothalamic Glioma, Chronic Lymphocytic Leukemia, Chronic Myelogenous Leukemia, Colon Cancer, Cutaneous T-Cell Lymphoma, Endocrine Pancreas Islet Cell Carcinoma, Endometrial Cancer, Ependymoma, Epithelial Cancer, Esophageal Cancer, Ewing's Sarcoma and Related Tumors, Exocrine Pancreatic Cancer, Extracranial Germ Cell Tumor, Extragonadal Germ Cell Tumor, Extrahepatic Bile Duct Cancer, Eye Cancer, Female Breast Cancer, Gaucher's Disease, Gallbladder Cancer, Gastric Cancer, Gastrointestinal Carcinoid Tumor, Gastrointestinal Tumors, Germ Cell Tumors, Gestational Trophoblastic Tumor, Hairy Cell Leukemia, Head and Neck Cancer, Hepatocellular Cancer, Hodgkin's Disease, Hodgkin's Lymphoma, Hypergammaglobulinemia, Hypopharyngeal Cancer, Intestinal Cancers, Intraocular Melanoma, Islet Cell Carcinoma, Islet Cell Pancreatic Cancer, Kaposi's Sarcoma, Kidney Cancer, Laryngeal Cancer, Lip and Oral Cavity Cancer, Liver Cancer, Lung Cancer, Lymphoproliferative Disorders, Macroglobulinemia, Male Breast Cancer, Malignant Mesothelioma, Malignant Thymoma, Medulloblastoma, Melanoma, Mesothelioma, Metastatic Occult Primary Squamous Neck Cancer, Metastatic Primary Squamous Neck Cancer, Metastatic Squamous Neck Cancer, Multiple Myeloma, Multiple Myeloma/Plasma Cell Neoplasm, Myelodysplastic Syndrome, Myelogenous Leukemia, Myeloid Leukemia, Myeloproliferative Disorders, Nasal Cavity and Paranasal Sinus Cancer, Nasopharyngeal Cancer, Neuroblastoma, Non-Hodgkin's Lymphoma During Pregnancy, Nonmelanoma Skin Cancer, Non-Small Cell Lung Cancer, Occult Primary Metastatic Squamous Neck Cancer, Oropharyngeal Cancer, Osteo-/Malignant Fibrous Sarcoma, Osteosarcoma/Malignant Fibrous Histiocytoma, Osteosarcoma/Malignant Fibrous Histiocytoma of Bone, Ovarian Epithelial Cancer, Ovarian Germ Cell Tumor, Ovarian Low Malignant Potential Tumor, Pancreatic Cancer, Paraproteinemias, Purpura, Parathyroid Cancer, Penile Cancer, Pheochromocytoma, Pituitary Tumor, Plasma Cell Neoplasm/Multiple Myeloma, Primary Central Nervous System Lymphoma, Primary Liver Cancer, Prostate Cancer, Rectal Cancer, Renal Cell Cancer, Renal Pelvis and Ureter Cancer, Retinoblastoma, Rhabdomyosarcoma, Salivary Gland Cancer, Sarcoidosis Sarcomas, Sezary Syndrome, Skin Cancer, Small Cell Lung Cancer, Small Intestine Cancer, Soft Tissue Sarcoma, Squamous Neck Cancer, Stomach Cancer, Supratentorial Primitive Neuroectodermal and Pineal Tumors, T-Cell Lymphoma, Testicular Cancer, Thymoma, Thyroid Cancer, Transitional Cell Cancer of the Renal Pelvis and Ureter, Transitional Renal Pelvis and Ureter Cancer, Trophoblastic Tumors, Ureter and Renal Pelvis Cell Cancer, Urethral Cancer, Uterine Cancer, Uterine Sarcoma, Vaginal Cancer, Visual Pathway and Hypothalamic Glioma, Vulvar Cancer, Waldenstrom's Macroglobulinemia, Wilms' Tumor, and any other hyperproliferative disease, besides neoplasia, located in an organ system listed above.

In another preferred embodiment, albumin fusion proteins of the invention and/or polynucleotides encoding albumin fusion proteins of the invention are used to diagnose, prognose, prevent, and/or treat premalignant conditions and to prevent progression to a neoplastic or malignant state, including but not limited to those disorders described above. Such uses are indicated in conditions known or suspected of preceding progression to neoplasia or cancer, in particular, where non-neoplastic cell growth consisting of hyperplasia, metaplasia, or most particularly, dysplasia has occurred (for review of such abnormal growth conditions, see Robbins and Angell, 1976, Basic Pathology, 2d Ed., W. B. Saunders Co., Philadelphia, pp. 68-79.)

Hyperplasia is a form of controlled cell proliferation, involving an increase in cell number in a tissue or organ, without significant alteration in structure or function. Hyperplastic disorders which can be diagnosed, prognosed, prevented, and/or treated with fusion proteins of the invention and/or polynucleotides encoding albumin fusion proteins of the invention include, but are not limited to, angiofollicular mediastinal lymph node hyperplasia, angiolymphoid hyperplasia with eosinophilia, atypical melanocytic hyperplasia, basal cell hyperplasia, benign giant lymph node hyperplasia, cementum hyperplasia, congenital adrenal hyperplasia, congenital sebaceous hyperplasia, cystic hyperplasia, cystic hyperplasia of the breast, denture hyperplasia, ductal hyperplasia, endometrial hyperplasia, fibromuscular hyperplasia, focal epithelial hyperplasia, gingival hyperplasia, inflammatory fibrous hyperplasia, inflammatory papillary hyperplasia, intravascular papillary endothelial hyperplasia, nodular hyperplasia of prostate, nodular regenerative hyperplasia, pseudoepitheliomatous hyperplasia, senile sebaceous hyperplasia, and verrucous hyperplasia.

Metaplasia is a form of controlled cell growth in which one type of adult or fully differentiated cell substitutes for another type of adult cell. Metaplastic disorders which can be diagnosed, prognosed, prevented, and/or treated with fusion proteins of the invention and/or polynucleotides encoding albumin fusion proteins of the invention include, but are not limited to, agnogenic myeloid metaplasia, apocrine metaplasia, atypical metaplasia, autoparenchymatous metaplasia, connective tissue metaplasia, epithelial metaplasia, intestinal metaplasia, metaplastic anemia, metaplastic ossification, metaplastic polyps, myeloid metaplasia, primary myeloid metaplasia, secondary myeloid metaplasia, squamous metaplasia, squamous metaplasia of amnion, and symptomatic myeloid metaplasia.

Dysplasia is frequently a forerunner of cancer, and is found mainly in the epithelia; it is the most disorderly form of non-neoplastic cell growth, involving a loss in individual cell uniformity and in the architectural orientation of cells. Dysplastic cells often have abnormally large, deeply stained nuclei, and exhibit pleomorphism. Dysplasia characteristically occurs where there exists chronic irritation or inflammation. Dysplastic disorders which can be diagnosed, prognosed, prevented, and/or treated with fusion proteins of the invention and/or polynucleotides encoding albumin fusion proteins of the invention include, but are not limited to, anhidrotic ectodermal dysplasia, anterofacial dysplasia, asphyxiating thoracic dysplasia, atriodigital dysplasia, bronchopulmonary dysplasia, cerebral dysplasia, cervical dysplasia, chondroectodermal dysplasia, cleidocranial dysplasia, congenital ectodermal dysplasia, craniodiaphysial dysplasia, craniocarpotarsal dysplasia, craniometaphysial dysplasia, dentin dysplasia, diaphysial dysplasia, ectodermal dysplasia, enamel dysplasia, encephalo-ophthalmic dysplasia, dysplasia epiphysialis hemimelia, dysplasia epiphysialis multiplex, dysplasia epiphysialis punctata, epithelial dysplasia, faciodigitogenital dysplasia, familial fibrous dysplasia of jaws, familial white folded dysplasia, fibromuscular dysplasia, fibrous dysplasia of bone, florid osseous dysplasia, hereditary renal-retinal dysplasia, hidrotic ectodermal dysplasia, hypohidrotic ectodermal dysplasia, lymphopenic thymic dysplasia, mammary dysplasia, mandibulofacial dysplasia, metaphysial dysplasia, Mondini dysplasia, monostotic fibrous dysplasia, mucoepithelial dysplasia, multiple epiphysial dysplasia, oculoauriculovertebral dysplasia, oculodentodigital dysplasia, oculovertebral dysplasia, odontogenic dysplasia, opthalmomandibulomelic dysplasia, periapical cemental dysplasia, polyostotic fibrous dysplasia, pseudoachondroplastic spondyloepiphysial dysplasia, retinal dysplasia, septo-optic dysplasia, spondyloepiphysial dysplasia, and ventriculoradial dysplasia.

Additional pre-neoplastic disorders which can be diagnosed, prognosed, prevented, and/or treated with fusion proteins of the invention and/or polynucleotides encoding albumin fusion proteins of the invention include, but are not limited to, benign dysproliferative disorders (e.g., benign tumors, fibrocystic conditions, tissue hypertrophy, intestinal polyps, colon polyps, and esophageal dysplasia), leukoplakia, keratoses, Bowen's disease, Farmer's Skin, solar cheilitis, and solar keratosis.

In another embodiment, albumin fusion proteins of the invention and/or polynucleotides encoding albumin fusion proteins of the invention, may be used to diagnose and/or prognose disorders associated with the tissue(s) in which the polypeptide of the invention is expressed.

In another embodiment, albumin fusion proteins of the invention and/or polynucleotides encoding albumin fusion proteins of the invention conjugated to a toxin or a radioactive isotope, as described herein, may be used to treat cancers and neoplasms, including, but not limited to, those described herein. In a further preferred embodiment, albumin fusion proteins of the invention and/or polynucleotides encoding albumin fusion proteins of the invention conjugated to a toxin or a radioactive isotope, as described herein, may be used to treat acute myelogenous leukemia.

Additionally, fusion proteins of the invention and/or polynucleotides encoding albumin fusion proteins of the invention may affect apoptosis, and therefore, would be useful in treating a number of diseases associated with increased cell survival or the inhibition of apoptosis. For example, diseases associated with increased cell survival or the inhibition of apoptosis that could be diagnosed, prognosed, prevented, and/or treated by polynucleotides, polypeptides, and/or agonists or antagonists of the invention, include cancers (such as follicular lymphomas, carcinomas with p53 mutations, and hormone-dependent tumors, including, but not limited to colon cancer, cardiac tumors, pancreatic cancer, melanoma, retinoblastoma, glioblastoma, lung cancer, intestinal cancer, testicular cancer, stomach cancer, neuroblastoma, myxoma, myoma, lymphoma, endothelioma, osteoblastoma, osteoclastoma, osteosarcoma, chondrosarcoma, adenoma, breast cancer, prostate cancer, Kaposi's sarcoma and ovarian cancer); autoimmune disorders such as, multiple sclerosis, Sjogren's syndrome, Hashimoto's thyroiditis, biliary cirrhosis, Behcet's disease, Crohn's disease, polymyositis, systemic lupus erythematosus and immune-related glomerulonephritis and rheumatoid arthritis) and viral infections (such as herpes viruses, pox viruses and adenoviruses), inflammation, graft v. host disease, acute graft rejection, and chronic graft rejection.

In preferred embodiments, fusion proteins of the invention and/or polynucleotides encoding albumin fusion proteins of the invention are used to inhibit growth, progression, and/or metastasis of cancers, in particular those listed above.

Additional diseases or conditions associated with increased cell survival that could be diagnosed, prognosed, prevented, and/or treated by fusion proteins of the invention and/or polynucleotides encoding albumin fusion proteins of the invention, include, but are not limited to, progression, and/or metastases of malignancies and related disorders such as leukemia (including acute leukemias (e.g., acute lymphocytic leukemia, acute myelocytic leukemia (including myeloblastic, promyelocytic, myelomonocytic, monocytic, and erythroleukemia)) and chronic leukemias (e.g., chronic myelocytic (granulocytic) leukemia and chronic lymphocytic leukemia)), polycythemia vera, lymphomas (e.g., Hodgkin's disease and non-Hodgkin's disease), multiple myeloma, Waldenstrom's macroglobulinemia, heavy chain disease, and solid tumors including, but not limited to, sarcomas and carcinomas such as fibrosarcoma, myxosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, colon carcinoma, pancreatic cancer, breast cancer, ovarian cancer, prostate cancer, squamous cell carcinoma, basal cell carcinoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, bile duct carcinoma, choriocarcinoma, seminoma, embryonal carcinoma, Wilm's tumor, cervical cancer, testicular tumor, lung carcinoma, small cell lung carcinoma, bladder carcinoma, epithelial carcinoma, glioma, astrocytoma, medulloblastoma, craniopharyngioma, ependymoma, pinealoma, emangioblastoma, acoustic neuroma, oligodendroglioma, menangioma, melanoma, neuroblastoma, and retinoblastoma.

Diseases associated with increased apoptosis that could be diagnosed, prognosed, prevented, and/or treated by fusion proteins of the invention and/or polynucleotides encoding albumin fusion proteins of the invention, include AIDS; neurodegenerative disorders (such as Alzheimer's disease, Parkinson's disease, amyotrophic lateral sclerosis, retinitis pigmentosa, cerebellar degeneration and brain tumor or prior associated disease); autoimmune disorders (such as, multiple sclerosis, Sjogren's syndrome, Hashimoto's thyroiditis, biliary cirrhosis, Behcet's disease, Crohn's disease, polymyositis, systemic lupus erythematosus and immune-related glomerulonephritis and rheumatoid arthritis) myelodysplastic syndromes (such as aplastic anemia), graft v. host disease, ischemic injury (such as that caused by myocardial infarction, stroke and reperfusion injury), liver injury (e.g., hepatitis related liver injury, ischemia/reperfusion injury, cholestosis (bile duct injury) and liver cancer); toxin-induced liver disease (such as that caused by alcohol), septic shock, cachexia and anorexia.

Hyperproliferative diseases and/or disorders that could be diagnosed, prognosed, prevented, and/or treated by fusion proteins of the invention and/or polynucleotides encoding albumin fusion proteins of the invention, include, but are not limited to, neoplasms located in the liver, abdomen, bone, breast, digestive system, pancreas, peritoneum, endocrine glands (adrenal, parathyroid, pituitary, testicles, ovary, thymus, thyroid), eye, head and neck, nervous system (central and peripheral), lymphatic system, pelvis, skin, soft tissue, spleen, thorax, and urogenital tract.

Similarly, other hyperproliferative disorders can also be diagnosed, prognosed, prevented, and/or treated by fusion proteins of the invention and/or polynucleotides encoding albumin fusion proteins of the invention. Examples of such hyperproliferative disorders include, but are not limited to: hypergammaglobulinemia, lymphoproliferative disorders, paraproteinemias, purpura, sarcoidosis, Sezary Syndrome, Waldenstron's macroglobulinemia, Gaucher's Disease, histiocytosis, and any other hyperproliferative disease, besides neoplasia, located in an organ system listed above.

Another preferred embodiment utilizes polynucleotides encoding albumin fusion proteins of the invention to inhibit aberrant cellular division, by gene therapy using the present invention, and/or protein fusions or fragments thereof.

Thus, the present invention provides a method for treating cell proliferative disorders by inserting into an abnormally proliferating cell a polynucleotide encoding an albumin fusion protein of the present invention, wherein said polynucleotide represses said expression.

Another embodiment of the present invention provides a method of treating cell-proliferative disorders in individuals comprising administration of one or more active gene copies of the present invention to an abnormally proliferating cell or cells. In a preferred embodiment, polynucleotides of the present invention is a DNA construct comprising a recombinant expression vector effective in expressing a DNA sequence encoding said polynucleotides. In another preferred embodiment of the present invention, the DNA construct encoding the fusion protein of the present invention is inserted into cells to be treated utilizing a retrovirus, or more preferably an adenoviral vector (See G J. Nabel, et. al., PNAS 1999 96: 324-326, which is hereby incorporated by reference). In a most preferred embodiment, the viral vector is defective and will not transform non-proliferating cells, only proliferating cells. Moreover, in a preferred embodiment, the polynucleotides of the present invention inserted into proliferating cells either alone, or in combination with or fused to other polynucleotides, can then be modulated via an external stimulus (i.e. magnetic, specific small molecule, chemical, or drug administration, etc.), which acts upon the promoter upstream of said polynucleotides to induce expression of the encoded protein product. As such the beneficial therapeutic affect of the present invention may be expressly modulated (i.e. to increase, decrease, or inhibit expression of the present invention) based upon said external stimulus.

Polynucleotides of the present invention may be useful in repressing expression of oncogenic genes or antigens. By "repressing expression of the oncogenic genes" is intended the suppression of the transcription of the gene, the degradation of the gene transcript (pre-message RNA), the inhibition of splicing, the destruction of the messenger RNA, the prevention of the post-translational modifications of the protein, the destruction of the protein, or the inhibition of the normal function of the protein.

For local administration to abnormally proliferating cells, polynucleotides of the present invention may be administered by any method known to those of skill in the art including, but not limited to transfection, electroporation, microinjection of cells, or in vehicles such as liposomes, lipofectin, or as naked polynucleotides, or any other method described throughout the specification. The polynucleotide of the present invention may be delivered by known gene delivery systems such as, but not limited to, retroviral vectors (Gilboa, J. Virology 44:845 (1982); Hocke, Nature 320:275 (1986); Wilson, et al., Proc. Natl. Acad. Sci. U.S.A. 85:3014), vaccinia virus system (Chakrabarty et al., Mol. Cell Biol. 5:3403 (1985) or other efficient DNA delivery systems (Yates et al., Nature 313:812 (1985)) known to those skilled in the art. These references are exemplary only and are hereby incorporated by reference. In order to specifically deliver or transfect cells which are abnormally proliferating and spare non-dividing cells, it is preferable to utilize a retrovirus, or adenoviral (as described in the art and elsewhere herein) delivery system known to those of skill in the art. Since host DNA replication is required for retroviral DNA to integrate and the retrovirus will be unable to self replicate due to the lack of the retrovirus genes needed for its life cycle. Utilizing such a retroviral delivery system for polynucleotides of the present invention will target said gene and constructs to abnormally proliferating cells and will spare the non-dividing normal cells.

The polynucleotides of the present invention may be delivered directly to cell proliferative disorder/disease sites in internal organs, body cavities and the like by use of imaging devices used to guide an injecting needle directly to the disease site. The polynucleotides of the present invention may also be administered to disease sites at the time of surgical intervention.

By "cell proliferative disease" is meant any human or animal disease or disorder, affecting any one or any combination of organs, cavities, or body parts, which is characterized by single or multiple local abnormal proliferations of cells, groups of cells, or tissues, whether benign or malignant.

Any amount of the polynucleotides of the present invention may be administered as long as it has a biologically inhibiting effect on the proliferation of the treated cells. Moreover, it is possible to administer more than one of the polynucleotide of the present invention simultaneously to the same site. By "biologically inhibiting" is meant partial or total growth inhibition as well as decreases in the rate of proliferation or growth of the cells. The biologically inhibitory dose may be determined by assessing the effects of the polynucleotides of the present invention on target malignant or abnormally proliferating cell growth in tissue culture, tumor growth in animals and cell cultures, or any other method known to one of ordinary skill in the art.

Moreover, fusion proteins of the invention and/or polynucleotides encoding albumin fusion proteins of the invention of the present invention are useful in inhibiting the angiogenesis of proliferative cells or tissues, either alone, as a protein fusion, or in combination with other polypeptides directly or indirectly, as described elsewhere herein. In a most preferred embodiment, said anti-angiogenesis effect may be achieved indirectly, for example, through the inhibition of hematopoietic, tumor-specific cells, such as tumor-associated macrophages (See Joseph I B, et al. J Natl Cancer Inst, 90(21): 1648-53 (1998), which is hereby incorporated by reference).

Albumin fusion proteins of the invention and/or polynucleotides encoding albumin fusion proteins of the invention may be useful in inhibiting proliferative cells or tissues through the induction of apoptosis. These fusion proteins and/or polynucleotides may act either directly, or indirectly to induce apoptosis of proliferative cells and tissues, for example in the activation of a death-domain receptor, such as tumor necrosis factor (TNF) receptor-1, CD95 (Fas/APO-1), TNF-receptor-related apoptosis-mediated protein (TRAMP) and TNF-related apoptosis-inducing ligand (TRAIL) receptor-1 and -2 (See Schulze-Osthoff K, et. al., Eur J Biochem 254(3):439-59 (1998), which is hereby incorporated by reference). Moreover, in another preferred embodiment of the present invention, these fusion proteins and/or polynucleotides may induce apoptosis through other mechanisms, such as in the activation of other proteins which will activate apoptosis, or through stimulating the expression of these proteins, either alone or in combination with small molecule drugs or adjuvants, such as apoptonin, galectins, thioredoxins, anti-inflammatory proteins (See for example, Mutat Res 400(1-2):447-55 (1998), Med Hypotheses. 50(5):423-33 (1998), Chem Biol Interact. April 24; 111-112:23-34 (1998), J Mol Med. 76(6):402-12 (1998), Int J Tissue React; 20(1):3-15 (1998), which are all hereby incorporated by reference).

Albumin fusion proteins of the invention and/or polynucleotides encoding albumin fusion proteins of the invention are useful in inhibiting the metastasis of proliferative cells or tissues. Inhibition may occur as a direct result of administering these albumin fusion proteins and/or polynucleotides, or indirectly, such as activating the expression of proteins known to inhibit metastasis, for example alpha 4 integrins, (See, e.g., Curr Top Microbiol Immunol 1998; 231:125-41, which is hereby incorporated by reference). Such therapeutic affects of the present invention may be achieved either alone, or in combination with small molecule drugs or adjuvants.

In another embodiment, the invention provides a method of delivering compositions containing the albumin fusion proteins of the invention and/or polynucleotides encoding albumin fusion proteins of the invention to targeted cells expressing the a polypeptide bound by, that binds to, or associates with an albumin fusion protein of the invention. Albumin fusion proteins of the invention may be associated with heterologous polypeptides, heterologous nucleic acids, toxins, or prodrugs via hydrophobic, hydrophilic, ionic and/or covalent interactions. Albumin fusion proteins of the invention are useful in enhancing the immunogenicity and/or antigenicity of proliferating cells or tissues, either directly, such as would occur if the albumin fusion proteins of the invention 'vaccinated' the immune response to respond to proliferative antigens and immunogens, or indirectly, such as in activating the expression of proteins known to enhance the immune response (e.g. chemokines), to said antigens and immunogens.

Renal Disorders

Albumin fusion proteins of the invention and/or polynucleotides encoding albumin fusion proteins of the invention, may be used to treat, prevent, diagnose, and/or prognose disorders of the renal system. Renal disorders which can be diagnosed, prognosed, prevented, and/or treated with compositions of the invention include, but are not limited to, kidney failure, nephritis, blood vessel disorders of kidney, metabolic and congenital kidney disorders, urinary disorders of the kidney, autoimmune disorders, sclerosis and necrosis, electrolyte imbalance, and kidney cancers.

Kidney diseases which can be diagnosed, prognosed, prevented, and/or treated with compositions of the invention include, but are not limited to, acute kidney failure, chronic kidney failure, atheroembolic renal failure, end-stage renal disease, inflammatory diseases of the kidney (e.g., acute glomerulonephritis, postinfectious glomerulonephritis, rapidly progressive glomerulonephritis, nephrotic syndrome, membranous glomerulonephritis, familial nephrotic syndrome, membranoproliferative glomerulonephritis I and II, mesangial proliferative glomerulonephritis, chronic glomerulonephritis, acute tubulointerstitial nephritis, chronic tubulointerstitial nephritis, acute post-streptococcal glomerulonephritis (PSGN), pyelonephritis, lupus nephritis, chronic nephritis, interstitial nephritis, and post-streptococcal glomerulonephritis), blood vessel disorders of the kidneys (e.g., kidney infarction, atheroembolic kidney disease, cortical necrosis, malignant nephrosclerosis, renal vein thrombosis, renal underperfusion, renal retinopathy, renal ischemia-reperfusion, renal artery embolism, and renal artery stenosis), and kidney disorders resulting form urinary tract disease (e.g., pyelonephritis, hydronephrosis, urolithiasis (renal lithiasis, nephrolithiasis), reflux nephropathy, urinary tract infections, urinary retention, and acute or chronic unilateral obstructive uropathy.)

In addition, compositions of the invention can be used to diagnose, prognose, prevent, and/or treat metabolic and congenital disorders of the kidney (e.g., uremia, renal amyloidosis, renal osteodystrophy, renal tubular acidosis, renal glycosuria, nephrogenic diabetes insipidus, cystinuria, Fanconi's syndrome, renal fibrocystic osteosis (renal rickets), Hartnup disease, Bartter's syndrome, Liddle's syndrome, polycystic kidney disease, medullary cystic disease, medullary sponge kidney, Alport's syndrome, nail-patella syndrome, congenital nephrotic syndrome, CRUSH syndrome, horseshoe kidney, diabetic nephropathy, nephrogenic diabetes insipidus, analgesic nephropathy, kidney stones, and membranous nephropathy), and autoimmune disorders of the kidney (e.g., systemic lupus erythematosus (SLE), Goodpasture syndrome, IgA nephropathy, and IgM mesangial proliferative glomerulonephritis).

Compositions of the invention can also be used to diagnose, prognose, prevent, and/or treat sclerotic or necrotic disorders of the kidney (e.g., glomerulosclerosis, diabetic nephropathy, focal segmental glomerulosclerosis (FSGS), necrotizing glomerulonephritis, and renal papillary necrosis), cancers of the kidney (e.g., nephroma, hypemephroma, nephroblastoma, renal cell cancer, transitional cell cancer, renal adenocarcinoma, squamous cell cancer, and Wilm's tumor), and electrolyte imbalances (e.g., nephrocalcinosis, pyuria, edema, hydronephritis, proteinuria, hyponatremia, hypematremia, hypokalemia, hyperkalemia, hypocalcemia, hypercalcemia, hypophosphatemia, and hyperphosphatemia).

Compositions of the invention may be administered using any method known in the art, including, but not limited to, direct needle injection at the delivery site, intravenous injection, topical administration, catheter infusion, biolistic injectors, particle accelerators, gelfoam sponge depots, other commercially available depot materials, osmotic pumps, oral or suppositorial solid pharmaceutical formulations, decanting or topical applications during surgery, aerosol delivery. Such methods are known in the art. Compositions of the invention may be administered as part of a Therapeutic, described in more detail below. Methods of delivering polynucleotides of the invention are described in more detail herein.

Cardiovascular Disorders

Albumin fusion proteins of the invention and/or polynucleotides encoding albumin fusion proteins of the invention, may be used to treat, prevent, diagnose, and/or prognose cardiovascular disorders, including, but not limited to, peripheral artery disease, such as limb ischemia.

Cardiovascular disorders include, but are not limited to, cardiovascular abnormalities, such as arterio-arterial fistula, arteriovenous fistula, cerebral arteriovenous malformations, congenital heart defects, pulmonary atresia, and Scimitar Syndrome. Congenital heart defects include, but are not limited to, aortic coarctation, cor triatriatum, coronary vessel anomalies, crisscross heart, dextrocardia, patent ductus arteriosus, Ebstein's anomaly, Eisenmenger complex, hypoplastic left heart syndrome, levocardia, tetralogy of fallot, transposition of great vessels, double outlet right ventricle, tricuspid atresia, persistent truncus arteriosus, and heart septal defects, such as aortopulmonary septal defect, endocardial cushion defects, Lutembacher's Syndrome, trilogy of Fallot, ventricular heart septal defects.

Cardiovascular disorders also include, but are not limited to, heart disease, such as arrhythmias, carcinoid heart disease, high cardiac output, low cardiac output, cardiac tamponade, endocarditis (including bacterial), heart aneurysm, cardiac arrest, congestive heart failure, congestive cardiomyopathy, paroxysmal dyspnea, cardiac edema, heart hypertrophy, congestive cardiomyopathy, left ventricular hypertrophy, right ventricular hypertrophy, post-infarction heart rupture, ventricular septal rupture, heart valve diseases, myocardial diseases, myocardial ischemia, pericardial effusion, pericarditis (including constrictive and tuberculous), pneumopericardium, postpericardiotomy syndrome, pulmonary heart disease, rheumatic heart disease, ventricular dysfunction, hyperemia, cardiovascular pregnancy complications, Scimitar Syndrome, cardiovascular syphilis, and cardiovascular tuberculosis.

Arrhythmias include, but are not limited to, sinus arrhythmia, atrial fibrillation, atrial flutter, bradycardia, extrasystole, Adams-Stokes Syndrome, bundle-branch block, sinoatrial block, long QT syndrome, parasystole, Lown-Ganong-Levine Syndrome, Mahaim-type pre-excitation syndrome, Wolff-Parkinson-White syndrome, sick sinus syndrome, tachycardias, and ventricular fibrillation. Tachycardias include paroxysmal tachycardia, supraventricular tachycardia, accelerated idioventricular rhythm, atrioventricular nodal reentry tachycardia, ectopic atrial tachycardia, ectopic junctional tachycardia, sinoatrial nodal reentry tachycardia, sinus tachycardia, Torsades de Pointes, and ventricular tachycardia.

Heart valve diseases include, but are not limited to, aortic valve insufficiency, aortic valve stenosis, hear murmurs, aortic valve prolapse, mitral valve prolapse, tricuspid valve prolapse, mitral valve insufficiency, mitral valve stenosis, pulmonary atresia, pulmonary valve insufficiency, pulmonary valve stenosis, tricuspid atresia, tricuspid valve insufficiency, and tricuspid valve stenosis.

Myocardial diseases include, but are not limited to, alcoholic cardiomyopathy, congestive cardiomyopathy, hypertrophic cardiomyopathy, aortic subvalvular stenosis, pulmonary subvalvular stenosis, restrictive cardiomyopathy, Chagas cardiomyopathy, endocardial fibroelastosis, endomyocardial fibrosis, Keams Syndrome, myocardial reperfusion injury, and myocarditis.

Myocardial ischemias include, but are not limited to, coronary disease, such as angina pectoris, coronary aneurysm, coronary arteriosclerosis, coronary thrombosis, coronary vasospasm, myocardial infarction and myocardial stunning.

Cardiovascular diseases also include vascular diseases such as aneurysms, angiodysplasia, angiomatosis, bacillary angiomatosis, Hippel-Lindau Disease, Klippel-Trenaunay-Weber Syndrome, Sturge-Weber Syndrome, angioneurotic edema, aortic diseases, Takayasu's Arteritis, aortitis, Leriche's Syndrome, arterial occlusive diseases, arteritis, enarteritis, polyarteritis nodosa, cerebrovascular disorders, diabetic angiopathies, diabetic retinopathy, embolisms, thrombosis, erythromelalgia, hemorrhoids, hepatic veno-occlusive disease, hypertension, hypotension, ischemia, peripheral vascular diseases, phlebitis, pulmonary veno-occlusive disease, Raynaud's disease, CREST syndrome, retinal vein occlusion, Scimitar syndrome, superior vena cava syndrome, telangiectasia, atacia telangiectasia, hereditary hemorrhagic telangiectasia, varicocele, varicose veins, varicose ulcer, vasculitis, and venous insufficiency.

Aneurysms include, but are not limited to, dissecting aneurysms, false aneurysms, infected aneurysms, ruptured aneurysms, aortic aneurysms, cerebral aneurysms, coronary aneurysms, heart aneurysms, and iliac aneurysms.

Arterial occlusive diseases include, but are not limited to, arteriosclerosis, intermittent claudication, carotid stenosis, fibromuscular dysplasias, mesenteric vascular occlusion, Moyamoya disease, renal artery obstruction, retinal artery occlusion, and thromboangiitis obliterans.

Cerebrovascular disorders include, but are not limited to, carotid artery diseases, cerebral amyloid angiopathy, cerebral aneurysm, cerebral anoxia, cerebral arteriosclerosis, cerebral arteriovenous malformation, cerebral artery diseases, cerebral embolism and thrombosis, carotid artery thrombosis, sinus thrombosis, Wallenberg's syndrome, cerebral hemorrhage, epidural hematoma, subdural hematoma, subaraxhnoid hemorrhage, cerebral infarction, cerebral ischemia (including transient), subclavian steal syndrome, periventricular leukomalacia, vascular headache, cluster headache, migraine, and vertebrobasilar insufficiency.

Embolisms include, but are not limited to, air embolisms, amniotic fluid embolisms, cholesterol embolisms, blue toe syndrome, fat embolisms, pulmonary embolisms, and thromoboembolisms. Thrombosis include, but are not limited to, coronary thrombosis, hepatic vein thrombosis, retinal vein occlusion, carotid artery thrombosis, sinus thrombosis, Wallenberg's syndrome, and thrombophlebitis.

Ischemic disorders include, but are not limited to, cerebral ischemia, ischemic colitis, compartment syndromes, anterior compartment syndrome, myocardial ischemia, reperfusion injuries, and peripheral limb ischemia. Vasculitis includes, but is not limited to, aortitis, arteritis, Behcet's Syndrome, Churg-Strauss Syndrome, mucocutaneous lymph node syndrome, thromboangiitis obliterans, hypersensitivity vasculitis, Schoenlein-Henoch purpura, allergic cutaneous vasculitis, and Wegener's granulomatosis.

Albumin fusion proteins of the invention and/or polynucleotides encoding albumin fusion proteins of the invention may be administered using any method known in the art, including, but not limited to, direct needle injection at the delivery site, intravenous injection, topical administration, catheter infusion, biolistic injectors, particle accelerators, gelfoam sponge depots, other commercially available depot materials, osmotic pumps, oral or suppositorial solid pharmaceutical formulations, decanting or topical applications during surgery, aerosol delivery. Such methods are known in the art. Methods of delivering polynucleotides are described in more detail herein.

Respiratory Disorders

Albumin fusion proteins of the invention and/or polynucleotides encoding albumin fusion proteins of the invention may be used to treat, prevent, diagnose, and/or prognose diseases and/or disorders of the respiratory system.

Diseases and disorders of the respiratory system include, but are not limited to, nasal vestibulitis, nonallergic rhinitis (e.g., acute rhinitis, chronic rhinitis, atrophic rhinitis, vasomotor rhinitis), nasal polyps, and sinusitis, juvenile angiofibromas, cancer of the nose and juvenile papillomas, vocal cord polyps, nodules (singer's nodules), contact ulcers, vocal cord paralysis, laryngoceles, pharyngitis (e.g., viral and bacterial), tonsillitis, tonsillar cellulitis, parapharyngeal abscess, laryngitis, laryngoceles, and throat cancers (e.g., cancer of the nasopharynx, tonsil cancer, larynx cancer), lung cancer (e.g., squamous cell carcinoma, small cell (oat cell) carcinoma, large cell carcinoma, and adenocarcinoma), allergic disorders (eosinophilic pneumonia, hypersensitivity pneumonitis (e.g., extrinsic allergic alveolitis, allergic interstitial pneumonitis, organic dust pneumoconiosis, allergic bronchopulmonary aspergillosis, asthma, Wegener's granulomatosis (granulomatous vasculitis), Goodpasture's syndrome)), pneumonia (e.g., bacterial pneumonia (e.g., *Streptococcus pneumoniae* (pneumoncoccal pneumonia), *Staphylococcus aureus* (staphylococcal pneumonia), Gram-negative bacterial pneumonia (caused by, e.g., *Klebsiella* and *Pseudomas* spp.), *Mycoplasma pneumoniae* pneumonia, *Hemophilus influenzae* pneumonia, *Legionella pneumophila* (Legionnaires' disease), and *Chlamydia psittaci* (Psittacosis)), and viral pneumonia (e.g., influenza, chickenpox (varicella).

Additional diseases and disorders of the respiratory system include, but are not limited to bronchiolitis, polio (poliomyelitis), croup, respiratory syncytial viral infection, mumps, erythema infectiosum (fifth disease), roseola infantum, progressive rubella panencephalitis, german measles, and subacute sclerosing panencephalitis), fungal pneumonia (e.g., Histoplasmosis, Coccidioidomycosis, Blastomycosis, fungal infections in people with severely suppressed immune systems (e.g., cryptococcosis, caused by *Cryptococcus neoformans*; aspergillosis, caused by *Aspergillus* spp.; candidiasis, caused by *Candida*; and mucormycosis)), *Pneumocystis carinii* (pneumocystis pneumonia), atypical pneumonias (e.g., *Mycoplasma* and *Chlamydia* spp.), opportunistic infection pneumonia, nosocomial pneumonia, chemical pneumonitis, and aspiration pneumonia, pleural disorders (e.g., pleurisy, pleural effusion, and pneumothorax (e.g., simple spontaneous pneumothorax, complicated spontaneous pneumothorax, tension pneumothorax)), obstructive airway diseases (e.g., asthma, chronic obstructive pulmonary disease (COPD), emphysema, chronic or acute bronchitis), occupational lung diseases (e.g., silicosis, black lung (coal workers' pneumoconiosis), asbestosis, berylliosis, occupational asthsma, byssinosis, and benign pneumoconioses), Infiltrative Lung Disease (e.g., pulmonary fibrosis (e.g., fibrosing alveolitis, usual interstitial pneumonia), idiopathic pulmonary fibrosis, desquamative interstitial pneumonia, lymphoid interstitial pneumonia, histiocytosis X (e.g., Letterer-Siwe disease, Hand-Schüller-Christian disease, eosinophilic granuloma), idiopathic pulmonary hemosiderosis, sarcoidosis and pulmonary alveolar proteinosis), Acute respiratory distress syndrome (also called, e.g., adult respiratory distress syndrome), edema, pulmonary embolism, bronchitis (e.g., viral, bacterial), bronchiectasis, atelectasis, lung abscess (caused by, e.g., *Staphylococcus aureus* or *Legionella pneumophila*), and cystic fibrosis.

Anti-Angiogenesis Activity

The naturally occurring balance between endogenous stimulators and inhibitors of angiogenesis is one in which inhibitory influences predominate. Rastinejad et al., *Cell* 56:345-355 (1989). In those rare instances in which neovascularization occurs under normal physiological conditions, such as wound healing, organ regeneration, embryonic development, and female reproductive processes, angiogenesis is stringently regulated and spatially and temporally delimited. Under conditions of pathological angiogenesis such as that characterizing solid tumor growth, these regulatory controls fail. Unregulated angiogenesis becomes pathologic and sustains progression of many neoplastic and non-neoplastic diseases. A number of serious diseases are dominated by abnormal neovascularization including solid tumor growth and metastases, arthritis, some types of eye disorders, and psoriasis. See, e.g., reviews by Moses et al., Biotech. 9:630-634 (1991); Folkman et al., *N. Engl. J. Med.,* 333:1757-1763 (1995); Auerbach et al., *J. Microvasc. Res.* 29:401-411 (1985); Folkman, Advances in Cancer Research, eds. Klein and Weinhouse, Academic Press, New York, pp. 175-203 (1985); Patz, *Am. J. Opthalmol.* 94:715-743 (1982); and Folkman et al., Science 221:719-725 (1983). In a number of pathological conditions, the process of angiogenesis contributes to the disease state. For example, significant data have accumulated which suggest that the growth of solid tumors is dependent on angiogenesis. Folkman and Klagsbrun, *Science* 235:442-447 (1987).

The present invention provides for treatment of diseases or disorders associated with neovascularization by administration of fusion proteins of the invention and/or polynucleotides encoding albumin fusion proteins of the invention. Malignant and metastatic conditions which can be treated with the polynucleotides and polypeptides, or agonists or antagonists of the invention include, but are not limited to, malignancies, solid tumors, and cancers described herein and otherwise known in the art (for a review of such disorders, see Fishman et al., Medicine, 2d Ed., J. B. Lippincott Co., Philadelphia (1985)). Thus, the present invention provides a method of treating an angiogenesis-related disease and/or disorder, comprising administering to an individual in need thereof a therapeutically effective amount of an albumin fusion protein of the invention and/or polynucleotides encoding an albumin fusion protein of the invention. For example, fusion proteins of the invention and/or polynucleotides encoding albumin fusion proteins of the invention may be utilized in a variety of additional methods in order to therapeutically treat a cancer or tumor. Cancers which may be treated with fusion proteins of the invention and/or polynucleotides encoding albumin fusion proteins of the invention include, but are not limited to solid tumors, including prostate, lung, breast, ovarian, stomach, pancreas, larynx, esophagus, testes, liver, parotid, biliary tract, colon, rectum, cervix, uterus, endometrium, kidney, bladder, thyroid cancer; primary tumors and metastases; melanomas; glioblastoma; Kaposi's sarcoma; leiomyosarcoma; non-small cell lung cancer; colorectal cancer; advanced malignancies; and blood born tumors such as leukemias. For example, fusion proteins of the invention and/or polynucleotides encoding albumin fusion proteins of the invention may be delivered topically, in order to treat cancers such as skin cancer, head and neck tumors, breast tumors, and Kaposi's sarcoma.

Within yet other aspects, fusion proteins of the invention and/or polynucleotides encoding albumin fusion proteins of the invention may be utilized to treat superficial forms of bladder cancer by, for example, intravesical administration. Albumin fusion proteins of the invention and/or polynucleotides encoding albumin fusion proteins of the invention may be delivered directly into the tumor, or near the tumor site, via injection or a catheter. Of course, as the artisan of ordinary skill will appreciate, the appropriate mode of administration will vary according to the cancer to be treated. Other modes of delivery are discussed herein.

Albumin fusion proteins of the invention and/or polynucleotides encoding albumin fusion proteins of the invention may be useful in treating other disorders, besides cancers, which involve angiogenesis. These disorders include, but are not limited to: benign tumors, for example hemangiomas, acoustic neuromas, neurofibromas, trachomas, and pyogenic granulomas; artheroscleric plaques; ocular angiogenic diseases, for example, diabetic retinopathy, retinopathy of prematurity, macular degeneration, corneal graft rejection, neovascular glaucoma, retrolental fibroplasia, rubeosis, retinoblastoma, uvietis and Pterygia (abnormal blood vessel growth) of the eye; rheumatoid arthritis; psoriasis; delayed wound healing; endometriosis; vasculogenesis; granulations; hypertrophic scars (keloids); nonunion fractures; scleroderma; trachoma; vascular adhesions; myocardial angiogenesis; coronary collaterals; cerebral collaterals; arteriovenous malformations; ischemic limb angiogenesis; Osler-Webber Syndrome; plaque neovascularization; telangiectasia; hemophiliac joints; angiofibroma; fibromuscular dysplasia; wound granulation; Crohn's disease; and atherosclerosis.

For example, within one aspect of the present invention methods are provided for treating hypertrophic scars and keloids, comprising the step of administering albumin fusion proteins of the invention and/or polynucleotides encoding albumin fusion proteins of the invention to a hypertrophic scar or keloid.

Within one embodiment of the present invention fusion proteins of the invention and/or polynucleotides encoding albumin fusion proteins of the invention are directly injected into a hypertrophic scar or keloid, in order to prevent the progression of these lesions. This therapy is of particular value in the prophylactic treatment of conditions which are known to result in the development of hypertrophic scars and keloids (e.g., burns), and is preferably initiated after the proliferative phase has had time to progress (approximately 14 days after the initial injury), but before hypertrophic scar or keloid development. As noted above, the present invention also provides methods for treating neovascular diseases of the eye, including for example, corneal neovascularization, neovascular glaucoma, proliferative diabetic retinopathy, retrolental fibroplasia and macular degeneration.

Moreover, Ocular disorders associated with neovascularization which can be treated with the albumin fusion proteins of the invention and/or polynucleotides encoding albumin fusion proteins of the invention include, but are not limited to: neovascular glaucoma, diabetic retinopathy, retinoblastoma, retrolental fibroplasia, uveitis, retinopathy of prematurity macular degeneration, corneal graft neovascularization, as well as other eye inflammatory diseases, ocular tumors and diseases associated with choroidal or iris neovascularization. See, e.g., reviews by Waltman et al., *Am. J. Ophthal.* 85:704-710 (1978) and Gartner et al., *Surv. Ophthal.* 22:291-312 (1978).

Thus, within one aspect of the present invention methods are provided for treating neovascular diseases of the eye such as corneal neovascularization (including corneal graft neovascularization), comprising the step of administering to a patient a therapeutically effective amount of a compound (e.g., fusion proteins of the invention and/or polynucleotides encoding albumin fusion proteins of the invention) to the cornea, such that the formation of blood vessels is inhibited. Briefly, the cornea is a tissue which normally lacks blood vessels. In certain pathological conditions however, capillaries may extend into the cornea from the pericorneal vascular plexus of the limbus. When the cornea becomes vascularized, it also becomes clouded, resulting in a decline in the patient's visual acuity. Visual loss may become complete if the cornea completely opacitates. A wide variety of disorders can result in corneal neovascularization, including for example, corneal infections (e.g., trachoma, herpes simplex keratitis, leishmaniasis and onchocerciasis), immunological processes (e.g., graft rejection and Stevens-Johnson's syndrome), alkali burns, trauma, inflammation (of any cause), toxic and nutritional deficiency states, and as a complication of wearing contact lenses.

Within particularly preferred embodiments of the invention, may be prepared for topical administration in saline (combined with any of the preservatives and antimicrobial agents commonly used in ocular preparations), and administered in eyedrop form. The solution or suspension may be prepared in its pure form and administered several times daily. Alternatively, anti-angiogenic compositions, prepared as described above, may also be administered directly to the cornea. Within preferred embodiments, the anti-angiogenic composition is prepared with a muco-adhesive polymer which binds to cornea. Within further embodiments, the anti-angiogenic factors or anti-angiogenic compositions may be utilized as an adjunct to conventional steroid therapy. Topical therapy may also be useful prophylactically in corneal lesions which are known to have a high probability of inducing an angiogenic response (such as chemical burns). In these instances the treatment, likely in combination with steroids, may be instituted immediately to help prevent subsequent complications.

Within other embodiments, the compounds described above may be injected directly into the corneal stroma by an ophthalmologist under microscopic guidance. The preferred site of injection may vary with the morphology of the individual lesion, but the goal of the administration would be to place the composition at the advancing front of the vasculature (i.e., interspersed between the blood vessels and the normal cornea). In most cases this would involve perilimbic corneal injection to "protect" the cornea from the advancing blood vessels. This method may also be utilized shortly after a corneal insult in order to prophylactically prevent corneal neovascularization. In this situation the material could be injected in the perilimbic cornea interspersed between the corneal lesion and its undesired potential limbic blood supply. Such methods may also be utilized in a similar fashion to prevent capillary invasion of transplanted corneas. In a sustained-release form injections might only be required 2-3 times per year. A steroid could also be added to the injection solution to reduce inflammation resulting from the injection itself.

Within another aspect of the present invention, methods are provided for treating neovascular glaucoma, comprising the step of administering to a patient a therapeutically effective amount of an albumin fusion protein of the invention and/or polynucleotides encoding an albumin fusion protein of the invention to the eye, such that the formation of blood vessels is inhibited. In one embodiment, the compound may be administered topically to the eye in order to treat early forms of neovascular glaucoma. Within other embodiments, the compound may be implanted by injection into the region of the anterior chamber angle. Within other embodiments, the compound may also be placed in any location such that the compound is continuously released into the aqueous humor. Within another aspect of the present invention, methods are provided for treating proliferative diabetic retinopathy, comprising the step of administering to a patient a therapeutically effective amount of an albumin fusion protein of the invention and/or polynucleotides encoding an albumin fusion protein of the invention to the eyes, such that the formation of blood vessels is inhibited.

Within particularly preferred embodiments of the invention, proliferative diabetic retinopathy may be treated by injection into the aqueous humor or the vitreous, in order to increase the local concentration of the polynucleotide, polypeptide, antagonist and/or agonist in the retina. Preferably, this treatment should be initiated prior to the acquisition of severe disease requiring photocoagulation.

Within another aspect of the present invention, methods are provided for treating retrolental fibroplasia, comprising the step of administering to a patient a therapeutically effective amount of an albumin fusion protein of the invention and/or polynucleotides encoding an albumin fusion protein of the invention to the eye, such that the formation of blood vessels is inhibited. The compound may be administered topically, via intravitreous injection and/or via intraocular implants.

Additionally, disorders which can be treated with fusion proteins of the invention and/or polynucleotides encoding albumin fusion proteins of the invention include, but are not limited to, hemangioma, arthritis, psoriasis, angiofibroma, atherosclerotic plaques, delayed wound healing, granulations, hemophilic joints, hypertrophic scars, nonunion fractures, Osler-Weber syndrome, pyogenic granuloma, scleroderma, trachoma, and vascular adhesions.

Moreover, disorders and/or states, which can be treated, prevented, diagnosed, and/or prognosed with the albumin fusion proteins of the invention and/or polynucleotides encoding albumin fusion proteins of the invention of the invention include, but are not limited to, solid tumors, blood born tumors such as leukemias, tumor metastasis, Kaposi's sarcoma, benign tumors, for example hemangiomas, acoustic neuromas, neurofibromas, trachomas, and pyogenic granulomas, rheumatoid arthritis, psoriasis, ocular angiogenic diseases, for example, diabetic retinopathy, retinopathy of prematurity, macular degeneration, corneal graft rejection, neovascular glaucoma, retrolental fibroplasia, rubeosis, retinoblastoma, and uvietis, delayed wound healing, endometriosis, vascluogenesis, granulations, hypertrophic scars (keloids), nonunion fractures, scleroderma, trachoma, vascular adhesions, myocardial angiogenesis, coronary collaterals, cerebral collaterals, arteriovenous malformations, ischemic limb angiogenesis, Osler-Webber Syndrome, plaque neovascularization, telangiectasia, hemophiliac joints, angiofibroma fibromuscular dysplasia, wound granulation, Crohn's disease, atherosclerosis, birth control agent by preventing vascularization required for embryo implantation controlling menstruation, diseases that have angiogenesis as a pathologic consequence such as cat scratch disease (*Rochele minalia quintosa*), ulcers (*Helicobacter pylori*), Bartonellosis and bacillary angiomatosis.

In one aspect of the birth control method, an amount of the compound sufficient to block embryo implantation is administered before or after intercourse and fertilization have occurred, thus providing an effective method of birth control, possibly a "morning after" method. Albumin fusion proteins of the invention and/or polynucleotides encoding albumin fusion proteins of the invention may also be used in controlling menstruation or administered as either a peritoneal lavage fluid or for peritoneal implantation in the treatment of endometriosis.

Albumin fusion proteins of the invention and/or polynucleotides encoding albumin fusion proteins of the invention may be incorporated into surgical sutures in order to prevent stitch granulomas.

Albumin fusion proteins of the invention and/or polynucleotides encoding albumin fusion proteins of the invention may be utilized in a wide variety of surgical procedures. For example, within one aspect of the present invention a compositions (in the form of, for example, a spray or film) may be utilized to coat or spray an area prior to removal of a tumor, in order to isolate normal surrounding tissues from malignant tissue, and/or to prevent the spread of disease to surrounding tissues. Within other aspects of the present invention, compositions (e.g., in the form of a spray) may be delivered via endoscopic procedures in order to coat tumors, or inhibit angiogenesis in a desired locale. Within yet other aspects of the present invention, surgical meshes which have been coated with anti-angiogenic compositions of the present invention may be utilized in any procedure wherein a surgical mesh might be utilized. For example, within one embodiment of the invention a surgical mesh laden with an anti-angiogenic composition may be utilized during abdominal cancer resection surgery (e.g., subsequent to colon resection) in order to provide support to the structure, and to release an amount of the anti-angiogenic factor.

Within further aspects of the present invention, methods are provided for treating tumor excision sites, comprising administering albumin fusion proteins of the invention and/or polynucleotides encoding albumin fusion proteins of the invention to the resection margins of a tumor subsequent to excision, such that the local recurrence of cancer and the formation of new blood vessels at the site is inhibited. Within one embodiment of the invention, the anti-angiogenic compound is administered directly to the tumor excision site (e.g., applied by swabbing, brushing or otherwise coating the resection margins of the tumor with the anti-angiogenic compound). Alternatively, the anti-angiogenic compounds may be incorporated into known surgical pastes prior to administration. Within particularly preferred embodiments of the invention, the anti-angiogenic compounds are applied after hepatic resections for malignancy, and after neurosurgical operations.

Within one aspect of the present invention, fusion proteins of the invention and/or polynucleotides encoding albumin fusion proteins of the invention may be administered to the resection margin of a wide variety of tumors, including for example, breast, colon, brain and hepatic tumors. For example, within one embodiment of the invention, anti-angiogenic compounds may be administered to the site of a neurological tumor subsequent to excision, such that the formation of new blood vessels at the site are inhibited.

The albumin fusion proteins of the invention and/or polynucleotides encoding albumin fusion proteins of the invention may also be administered along with other anti-angiogenic factors. Representative examples of other anti-angiogenic factors include: Anti-Invasive Factor, retinoic acid and derivatives thereof, paclitaxel, Suramin, Tissue Inhibitor of Metalloproteinase-1, Tissue Inhibitor of Metalloproteinase-2, Plasminogen Activator Inhibitor-1, Plasminogen Activator Inhibitor-2, and various forms of the lighter "d group" transition metals.

Lighter "d group" transition metals include, for example, vanadium, molybdenum, tungsten, titanium, niobium, and tantalum species. Such transition metal species may form transition metal complexes. Suitable complexes of the above-mentioned transition metal species include oxo transition metal complexes.

Representative examples of vanadium complexes include oxo vanadium complexes such as vanadate and vanadyl complexes. Suitable vanadate complexes include metavanadate and orthovanadate complexes such as, for example, ammonium metavanadate, sodium metavanadate, and sodium orthovanadate. Suitable vanadyl complexes include, for example, vanadyl acetylacetonate and vanadyl sulfate including vanadyl sulfate hydrates such as vanadyl sulfate mono- and trihydrates.

Representative examples of tungsten and molybdenum complexes also include oxo complexes. Suitable oxo tungsten complexes include tungstate and tungsten oxide complexes. Suitable tungstate complexes include ammonium tungstate, calcium tungstate, sodium tungstate dihydrate, and tungstic acid. Suitable tungsten oxides include tungsten (IV) oxide and tungsten (VI) oxide. Suitable oxo molybdenum complexes include molybdate, molybdenum oxide, and molybdenyl complexes. Suitable molybdate complexes include ammonium molybdate and its hydrates, sodium molybdate and its hydrates, and potassium molybdate and its hydrates. Suitable molybdenum oxides include molybdenum (VI) oxide, molybdenum (VI) oxide, and molybdic acid. Suitable molybdenyl complexes include, for example, molybdenyl acetylacetonate. Other suitable tungsten and molybdenum complexes include hydroxo derivatives derived from, for example, glycerol, tartaric acid, and sugars.

A wide variety of other anti-angiogenic factors may also be utilized within the context of the present invention. Representative examples include platelet factor 4; protamine sulphate; sulphated chitin derivatives (prepared from queen crab shells), (Murata et al., Cancer Res. 51:22-26, 1991); Sulphated Polysaccharide Peptidoglycan Complex (SP-PG) (the function of this compound may be enhanced by the presence of steroids such as estrogen, and tamoxifen citrate); Staurosporine; modulators of matrix metabolism, including for example, proline analogs, cishydroxyproline, d,L-3,4-dehydroproline, Thiaproline, alpha,alpha-dipyridyl, aminopropionitrile fumarate; 4-propyl-5-(4-pyridinyl)-2(3H)-oxazolone; Methotrexate; Mitoxantrone; Heparin; Interferons; 2 Macroglobulin-serum; ChIMP-3 (Pavloff et al., J. Bio. Chem. 267:17321-17326, (1992)); Chymostatin (Tomkinson et al., Biochem J. 286:475-480, (1992)); Cyclodextrin Tetradecasulfate; Eponemycin; Camptothecin; Fumagillin (Ingber et al., Nature 348:555-557, 1990); Gold Sodium Thiomalate ("GST"; Matsubara and Ziff, J. Clin. Invest. 79:1440-1446, (1987)); anticollagenase-serum; alpha2-antiplasmin (Holmes et al., J. Biol. Chem. 262(4):1659-1664, (1987)); Bisantrene (National Cancer Institute); Lobenzarit disodium (N-(2)-carboxyphenyl-4-chloroanthronilic acid disodium or "CCA"; Takeuchi et al., Agents Actions 36:312-316, (1992)); Thalidomide; Angostatic steroid; AGM-1470; carboxynaminolmidazole; and metalloproteinase inhibitors such as BB94.

Diseases at the Cellular Level

Diseases associated with increased cell survival or the inhibition of apoptosis that could be treated, prevented, diagnosed, and/or prognosed using fusion proteins of the invention and/or polynucleotides encoding albumin fusion proteins of the invention, include cancers (such as follicular lymphomas, carcinomas with p53 mutations, and hormone-dependent tumors, including, but not limited to colon cancer, cardiac tumors, pancreatic cancer, melanoma, retinoblastoma, glioblastoma, lung cancer, intestinal cancer, testicular cancer, stomach cancer, neuroblastoma, myxoma, myoma, lymphoma, endothelioma, osteoblastoma, osteoclastoma, osteosarcoma, chondrosarcoma, adenoma, breast cancer, prostate cancer, Kaposi's sarcoma and ovarian cancer); autoimmune disorders (such as, multiple sclerosis, Sjogren's syndrome, Hashimoto's thyroiditis, biliary cirrhosis, Behcet's disease, Crohn's disease, polymyositis, systemic lupus erythematosus and immune-related glomerulonephritis and rheumatoid arthritis) and viral infections (such as herpes viruses, pox viruses and adenoviruses), inflammation, graft v. host disease, acute graft rejection, and chronic graft rejection.

In preferred embodiments, fusion proteins of the invention and/or polynucleotides encoding albumin fusion proteins of the invention are used to inhibit growth, progression, and/or metasis of cancers, in particular those listed above.

Additional diseases or conditions associated with increased cell survival that could be treated or detected by fusion proteins of the invention and/or polynucleotides encoding albumin fusion proteins of the invention include, but are not limited to, progression, and/or metastases of malignancies and related disorders such as leukemia (including acute leukemias (e.g., acute lymphocytic leukemia, acute myelocytic leukemia (including myeloblastic, promyelocytic, myelomonocytic, monocytic, and erythroleukemia)) and chronic leukemias (e.g., chronic myelocytic (granulocytic) leukemia and chronic lymphocytic leukemia)), polycythemia vera, lymphomas (e.g., Hodgkin's disease and non-Hodgkin's disease), multiple myeloma, Waldenstrom's macroglobulinemia, heavy chain disease, and solid tumors including, but not limited to, sarcomas and carcinomas such as fibrosarcoma, myxosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, colon carcinoma, pancreatic cancer, breast cancer, ovarian cancer, prostate cancer, squamous cell carcinoma, basal cell carcinoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, bile duct carcinoma, choriocarcinoma, seminoma, embryonal carcinoma, Wilm's tumor, cervical cancer, testicular tumor, lung carcinoma, small cell lung carcinoma, bladder carcinoma, epithelial carcinoma, glioma, astrocytoma, medulloblastoma, craniopharyngioma, ependymoma, pinealoma, hemangioblastoma, acoustic neuroma, oligodendroglioma, menangioma, melanoma, neuroblastoma, and retinoblastoma.

Diseases associated with increased apoptosis that could be treated, prevented, diagnosed, and/or prognesed using fusion proteins of the invention and/or polynucleotides encoding albumin fusion proteins of the invention, include, but are not limited to, AIDS; neurodegenerative disorders (such as Alzheimer's disease, Parkinson's disease, Amyotrophic lateral sclerosis, Retinitis pigmentosa, Cerebellar degeneration and brain tumor or prior associated disease); autoimmune disorders (such as, multiple sclerosis, Sjogren's syndrome, Hashimoto's thyroiditis, biliary cirrhosis, Behcet's disease, Crohn's disease, polymyositis, systemic lupus erythematosus and immune-related glomerulonephritis and rheumatoid arthritis) myelodysplastic syndromes (such as aplastic anemia), graft v. host disease, ischemic injury (such as that caused by myocardial infarction, stroke and reperfusion injury), liver injury (e.g., hepatitis related liver injury, ischemia/reperfusion injury, cholestosis (bile duct injury) and liver cancer); toxin-induced liver disease (such as that caused by alcohol), septic shock, cachexia and anorexia.

Wound Healing and Epithelial Cell Proliferation

In accordance with yet a further aspect of the present invention, there is provided a process for utilizing fusion proteins of the invention and/or polynucleotides encoding albumin fusion proteins of the invention, for therapeutic purposes, for example, to stimulate epithelial cell proliferation and basal keratinocytes for the purpose of wound healing, and to stimulate hair follicle production and healing of dermal wounds. Albumin fusion proteins of the invention and/or polynucleotides encoding albumin fusion proteins of the invention, may be clinically useful in stimulating wound healing including surgical wounds, excisional wounds, deep wounds involving damage of the dermis and epidermis, eye tissue wounds, dental tissue wounds, oral cavity wounds, diabetic ulcers, dermal ulcers, cubitus ulcers, arterial ulcers, venous stasis ulcers, burns resulting from heat exposure or chemicals, and other abnormal wound healing conditions such as uremia, malnutrition, vitamin deficiencies and complications associated with systemic treatment with steroids, radiation therapy and antineoplastic drugs and antimetabolites. Albumin fusion proteins of the invention and/or polynucleotides encoding albumin fusion proteins of the invention, could be used to promote dermal reestablishment subsequent to dermal loss Albumin fusion proteins of the invention and/or polynucleotides encoding albumin fusion proteins of the invention, could be used to increase the adherence of skin grafts to a wound bed and to stimulate re-epithelialization from the wound bed. The following are types of grafts that fusion proteins of the invention and/or polynucleotides encoding albumin fusion proteins of the invention, could be used to increase adherence to a wound bed: autografts, artificial skin, allografts, autodermic graft, autoepdermic grafts, avacular grafts, Blair-Brown grafts, bone graft, brephoplastic grafts, cutis graft, delayed graft, dermic graft, epidermic graft, fascia graft, full thickness graft, heterologous graft, xenograft, homologous graft, hyperplastic graft, lamellar graft, mesh graft, mucosal graft, Ollier-Thiersch graft, omenpal graft, patch graft, pedicle graft, penetrating graft, split skin graft, thick split graft. Albumin fusion proteins of the invention and/or polynucleotides encoding albumin fusion proteins of the invention, can be used to promote skin strength and to improve the appearance of aged skin.

It is believed that fusion proteins of the invention and/or polynucleotides encoding albumin fusion proteins of the invention, will also produce changes in hepatocyte proliferation, and epithelial cell proliferation in the lung, breast, pancreas, stomach, small intestine, and large intestine. Albumin fusion proteins of the invention and/or polynucleotides encoding albumin fusion proteins of the invention, could promote proliferation of epithelial cells such as sebocytes, hair follicles, hepatocytes, type II pneumocytes, mucin-producing goblet cells, and other epithelial cells and their progenitors contained within the skin, lung, liver, and gastrointestinal tract. Albumin fusion proteins of the invention and/or polynucleotides encoding albumin fusion proteins of the invention, may promote proliferation of endothelial cells, keratinocytes, and basal keratinocytes.

Albumin fusion proteins of the invention and/or polynucleotides encoding albumin fusion proteins of the invention, could also be used to reduce the side effects of gut toxicity that result from radiation, chemotherapy treatments or viral infections. Albumin fusion proteins of the invention and/or polynucleotides encoding albumin fusion proteins of the invention, may have a cytoprotective effect on the small intestine mucosa. Albumin fusion proteins of the invention and/or polynucleotides encoding albumin fusion proteins of the invention, may also stimulate healing of mucositis (mouth ulcers) that result from chemotherapy and viral infections.

Albumin fusion proteins of the invention and/or polynucleotides encoding albumin fusion proteins of the invention, could further be used in full regeneration of skin in full and partial thickness skin defects, including burns, (i.e., repopulation of hair follicles, sweat glands, and sebaceous glands), treatment of other skin defects such as psoriasis. Albumin fusion proteins of the invention and/or polynucleotides encoding albumin fusion proteins of the invention, could be used to treat epidermolysis bullosa, a defect in adherence of the epidermis to the underlying dermis which results in frequent, open and painful blisters by accelerating reepithelialization of these lesions.

Albumin fusion proteins of the invention and/or polynucleotides encoding albumin fusion proteins of the invention, could also be used to treat gastric and doudenal ulcers and help heal by scar formation of the mucosal lining and regeneration of glandular mucosa and duodenal mucosal lining more rapidly. Inflammatory bowel diseases, such as Crohn's disease and ulcerative colitis, are diseases which result in destruction of the mucosal surface of the small or large intestine, respectively. Thus, fusion proteins of the invention and/or polynucleotides encoding albumin fusion proteins of the invention, could be used to promote the resurfacing of the mucosal surface to aid more rapid healing and to prevent progression of inflammatory bowel disease. Treatment with fusion proteins of the invention and/or polynucleotides encoding albumin fusion proteins of the invention, is expected to have a significant effect on the production of mucus throughout the gastrointestinal tract and could be used to protect the intestinal mucosa from injurious substances that are ingested or following surgery. Albumin fusion proteins of the invention and/or polynucleotides encoding albumin fusion proteins of the invention, could be used to treat diseases associate with the under expression.

Moreover, fusion proteins of the invention and/or polynucleotides encoding albumin fusion proteins of the invention, could be used to prevent and heal damage to the lungs due to various pathological states. Albumin fusion proteins of the invention and/or polynucleotides encoding albumin fusion proteins of the invention, which could stimulate proliferation and differentiation and promote the repair of alveoli and brochiolar epithelium to prevent or treat acute or chronic lung damage. For example, emphysema, which results in the progressive loss of aveoli, and inhalation injuries, i.e., resulting from smoke inhalation and burns, that cause necrosis of the bronchiolar epithelium and alveoli could be effectively treated using polynucleotides or polypeptides, agonists or antagonists of the present invention. Also fusion proteins of the invention and/or polynucleotides encoding albumin fusion proteins of the invention, could be used to stimulate the proliferation of and differentiation of type II pneumocytes, which may help treat or prevent disease such as hyaline membrane diseases, such as infant respiratory distress syndrome and bronchopulmonary displasia, in premature infants.

Albumin fusion proteins of the invention and/or polynucleotides encoding albumin fusion proteins of the invention, could stimulate the proliferation and differentiation of hepatocytes and, thus, could be used to alleviate or treat liver diseases and pathologies such as fulminant liver failure caused by cirrhosis, liver damage caused by viral hepatitis and toxic substances (i.e., acetaminophen, carbon tetraholoride and other hepatotoxins known in the art).

In addition, fusion proteins of the invention and/or polynucleotides encoding albumin fusion proteins of the invention, could be used treat or prevent the onset of diabetes mellitus. In patients with newly diagnosed Types I and II diabetes, where some islet cell function remains, fusion proteins of the invention and/or polynucleotides encoding albumin fusion proteins of the invention, could be used to maintain the islet function so as to alleviate, delay or prevent permanent manifestation of the disease. Also, fusion proteins of the invention and/or polynucleotides encoding albumin fusion proteins of the invention, could be used as an auxiliary in islet cell transplantation to improve or promote islet cell function.

Neural Activity and Neurological Diseases

The albumin fusion proteins of the invention and/or polynucleotides encoding albumin fusion proteins of the invention may be used for the diagnosis and/or treatment of diseases, disorders, damage or injury of the brain and/or nervous system. Nervous system disorders that can be treated with the compositions of the invention (e.g., fusion proteins of the invention and/or polynucleotides encoding albumin fusion proteins of the invention), include, but are not limited to, nervous system injuries, and diseases or disorders which result in either a disconnection of axons, a diminution or degeneration of neurons, or demyelination. Nervous system lesions which may be treated in a patient (including human and non-human mammalian patients) according to the methods of the invention, include but are not limited to, the following lesions of either the central (including spinal cord, brain) or peripheral nervous systems: (1) ischemic lesions, in which a lack of oxygen in a portion of the nervous system results in neuronal injury or death, including cerebral infarction or ischemia, or spinal cord infarction or ischemia; (2) traumatic lesions, including lesions caused by physical injury or associated with surgery, for example, lesions which sever a portion of the nervous system, or compression injuries; (3) malignant lesions, in which a portion of the nervous system is destroyed or injured by malignant tissue which is either a nervous system associated malignancy or a malignancy derived from non-nervous system tissue; (4) infectious lesions, in which a portion of the nervous system is destroyed or injured as a result of infection, for example, by an abscess or associated with infection by human immunodeficiency virus, herpes zoster, or herpes simplex virus or with Lyme disease, tuberculosis, or syphilis; (5) degenerative lesions, in which a portion of the nervous system is destroyed or injured as a result of a degenerative process including but not limited to, degeneration associated with Parkinson's disease, Alzheimer's disease, Huntington's chorea, or amyotrophic lateral sclerosis (ALS); (6) lesions associated with nutritional diseases or disorders, in which a portion of the nervous system is destroyed or injured by a nutritional disorder or disorder of metabolism including, but not limited to, vitamin B12 deficiency, folic acid deficiency, Wernicke disease, tobacco-alcohol amblyopia, Marchiafava-Bignami disease (primary degeneration of the corpus callosum), and alcoholic cerebellar degeneration; (7) neurological lesions associated with systemic diseases including, but not limited to, diabetes (diabetic neuropathy, Bell's palsy), systemic lupus erythematosus, carcinoma, or sarcoidosis; (8) lesions caused by toxic substances including alcohol, lead, or particular neurotoxins; and (9) demyelinated lesions in which a portion of the nervous system is destroyed or injured by a demyelinating disease including, but not limited to, multiple sclerosis, human immunodeficiency virus-associated myelopathy, transverse myelopathy or various etiologies, progressive multifocal leukoencephalopathy, and central pontine myelinolysis.

In one embodiment, the albumin fusion proteins of the invention and/or polynucleotides encoding albumin fusion proteins of the invention are used to protect neural cells from the damaging effects of hypoxia. In a further preferred embodiment, the albumin fusion proteins of the invention and/or polynucleotides encoding albumin fusion proteins of the invention are used to protect neural cells from the damaging effects of cerebral hypoxia. According to this embodiment, the compositions of the invention are used to treat or prevent neural cell injury associated with cerebral hypoxia. In one non-exclusive aspect of this embodiment, the albumin fusion proteins of the invention and/or polynucleotides encoding albumin fusion proteins of the invention, are used to treat or prevent neural cell injury associated with cerebral ischemia. In another non-exclusive aspect of this embodiment, the albumin fusion proteins of the invention and/or polynucleotides encoding albumin fusion proteins of the invention are used to treat or prevent neural cell injury associated with cerebral infarction.

In another preferred embodiment, albumin fusion proteins of the invention and/or polynucleotides encoding albumin fusion proteins of the invention are used to treat or prevent neural cell injury associated with a stroke. In a specific embodiment, albumin fusion proteins of the invention and/or polynucleotides encoding albumin fusion proteins of the invention are used to treat or prevent cerebral neural cell injury associated with a stroke.

In another preferred embodiment, albumin fusion proteins of the invention and/or polynucleotides encoding albumin fusion proteins of the invention are used to treat or prevent neural cell injury associated with a heart attack. In a specific embodiment, albumin fusion proteins of the invention and/or polynucleotides encoding albumin fusion proteins of the invention are used to treat or prevent cerebral neural cell injury associated with a heart attack.

The compositions of the invention which are useful for treating or preventing a nervous system disorder may be selected by testing for biological activity in promoting the survival or differentiation of neurons. For example, and not by way of limitation, compositions of the invention which elicit any of the following effects may be useful according to the invention: (1) increased survival time of neurons in culture either in the presence or absence of hypoxia or hypoxic conditions; (2) increased sprouting of neurons in culture or in vivo; (3) increased production of a neuron-associated molecule in culture or in vivo, e.g., choline acetyltransferase or acetylcholinesterase with respect to motor neurons; or (4) decreased symptoms of neuron dysfunction in vivo. Such effects may be measured by any method known in the art. In preferred, non-limiting embodiments, increased survival of neurons may routinely be measured using a method set forth herein or otherwise known in the art, such as, for example, in Zhang et al., *Proc Natl Acad Sci USA* 97:3637-42 (2000) or in Arakawa et al., *J. Neurosci.,* 10:3507-15 (1990); increased sprouting of neurons may be detected by methods known in the art, such as, for example, the methods set forth in Pestronk et al., *Exp. Neurol.,* 70:65-82 (1980), or Brown et al., *Ann. Rev. Neurosci.,* 4:17-42 (1981); increased production of neuron-associated molecules may be measured by bioassay, enzymatic assay, antibody binding, Northern blot assay, etc., using techniques known in the art and depending on the molecule to be measured; and motor neuron dysfunction may be measured by assessing the physical manifestation of motor neuron disorder, e.g., weakness, motor neuron conduction velocity, or functional disability.

In specific embodiments, motor neuron disorders that may be treated according to the invention include, but are not limited to, disorders such as infarction, infection, exposure to toxin, trauma, surgical damage, degenerative disease or malignancy that may affect motor neurons as well as other components of the nervous system, as well as disorders that selectively affect neurons such as amyotrophic lateral sclerosis, and including, but not limited to, progressive spinal muscular atrophy, progressive bulbar palsy, primary lateral sclerosis, infantile and juvenile muscular atrophy, progressive bulbar paralysis of childhood (Fazio-Londe syndrome), poliomyelitis and the post polio syndrome, and Hereditary Motorsensory Neuropathy (Charcot-Marie-Tooth Disease).

Further, fusion proteins of the invention and/or polynucleotides encoding albumin fusion proteins of the invention may play a role in neuronal survival; synapse formation; conductance; neural differentiation, etc. Thus, compositions of the invention (including fusion proteins of the invention and/or polynucleotides encoding albumin fusion proteins of the invention) may be used to diagnose and/or treat or prevent diseases or disorders associated with these roles, including, but not limited to, learning and/or cognition disorders. The compositions of the invention may also be useful in the treatment or prevention of neurodegenerative disease states and/or behavioural disorders. Such neurodegenerative disease states and/or behavioral disorders include, but are not limited to, Alzheimer's Disease, Parkinson's Disease, Huntington's Disease, Tourette Syndrome, schizophrenia, mania, dementia, paranoia, obsessive compulsive disorder, panic disorder, learning disabilities, ALS, psychoses, autism, and altered behaviors, including disorders in feeding, sleep patterns, balance, and perception. In addition, compositions of the invention may also play a role in the treatment, prevention and/or detection of developmental disorders associated with the developing embryo, or sexually-linked disorders.

Additionally, fusion proteins of the invention and/or polynucleotides encoding albumin fusion proteins of the invention, may be useful in protecting neural cells from diseases, damage, disorders, or injury, associated with cerebrovascular disorders including, but not limited to, carotid artery diseases (e.g., carotid artery thrombosis, carotid stenosis, or Moyamoya Disease), cerebral amyloid angiopathy, cerebral aneurysm, cerebral anoxia, cerebral arteriosclerosis, cerebral arteriovenous malformations, cerebral artery diseases, cerebral embolism and thrombosis (e.g., carotid artery thrombosis, sinus thrombosis, or Wallenberg's Syndrome), cerebral hemorrhage (e.g., epidural or subdural hematoma, or subarachnoid hemorrhage), cerebral infarction, cerebral ischemia (e.g., transient cerebral ischemia, Subclavian Steal Syndrome, or vertebrobasilar insufficiency), vascular dementia (e.g., multi-infarct), leukomalacia, periventricular, and vascular headache (e.g., cluster headache or migraines).

In accordance with yet a further aspect of the present invention, there is provided a process for utilizing fusion proteins of the invention and/or polynucleotides encoding albumin fusion proteins of the invention, for therapeutic purposes, for example, to stimulate neurological cell proliferation and/or differentiation. Therefore, fusion proteins of the invention and/or polynucleotides encoding albumin fusion proteins of the invention may be used to treat and/or detect neurologic diseases. Moreover, fusion proteins of the invention and/or polynucleotides encoding albumin fusion proteins of the invention, can be used as a marker or detector of a particular nervous system disease or disorder.

Examples of neurologic diseases which can be treated or detected with fusion proteins of the invention and/or polynucleotides encoding albumin fusion proteins of the invention include, brain diseases, such as metabolic brain diseases which includes phenylketonuria such as maternal phenylketonuria, pyruvate carboxylase deficiency, pyruvate dehydrogenase complex deficiency, Wernicke's Encephalopathy, brain edema, brain neoplasms such as cerebellar neoplasms which include infratentorial neoplasms, cerebral ventricle neoplasms such as choroid plexus neoplasms, hypothalamic neoplasms, supratentorial neoplasms, canavan disease, cerebellar diseases such as cerebellar ataxia which include spinocerebellar degeneration such as ataxia telangiectasia, cerebellar dyssynergia, Friederich's Ataxia, Machado-Joseph Disease, olivopontocerebellar atrophy, cerebellar neoplasms such as infratentorial neoplasms, diffuse cerebral sclerosis such as encephalitis periaxialis, globoid cell leukodystrophy, metachromatic leukodystrophy and subacute sclerosing panencephalitis.

Additional neurologic diseases which can be treated or detected with fusion proteins of the invention and/or polynucleotides encoding albumin fusion proteins of the invention include cerebrovascular disorders (such as carotid artery diseases which include carotid artery thrombosis, carotid stenosis and Moyamoya Disease), cerebral amyloid angiopathy, cerebral aneurysm, cerebral anoxia, cerebral arteriosclerosis, cerebral arteriovenous malformations, cerebral artery diseases, cerebral embolism and thrombosis such as carotid artery thrombosis, sinus thrombosis and Wallenberg's Syndrome, cerebral hemorrhage such as epidural hematoma, subdural hematoma and subarachnoid hemorrhage, cerebral infarction, cerebral ischemia such as transient cerebral ischemia, Subclavian Steal Syndrome and vertebrobasilar insufficiency, vascular dementia such as multi-infarct dementia, periventricular leukomalacia, vascular headache such as cluster headache and migraine.

Additional neurologic diseases which can be treated or detected with fusion proteins of the invention and/or polynucleotides encoding albumin fusion proteins of the invention include dementia such as AIDS Dementia Complex, presenile dementia such as Alzheimer's Disease and Creutzfeldt-Jakob Syndrome, senile dementia such as Alzheimer's Disease and progressive supranuclear palsy, vascular dementia such as multi-infarct dementia, encephalitis which include encephalitis periaxialis, viral encephalitis such as epidemic encephalitis, Japanese Encephalitis, St. Louis Encephalitis, tick-borne encephalitis and West Nile Fever, acute disseminated encephalomyelitis, meningoencephalitis such as uveomeningoencephalitic syndrome, Postencephalitic Parkinson Disease and subacute sclerosing panencephalitis, encephalomalacia such as periventricular leukomalacia, epilepsy such as generalized epilepsy which includes infantile spasms, absence epilepsy, myoclonic epilepsy which includes MERRF Syndrome, tonic-clonic epilepsy, partial epilepsy such as complex partial epilepsy, frontal lobe epilepsy and temporal lobe epilepsy, post-traumatic epilepsy, status epilepticus such as Epilepsia Partialis Continua, and Hallervorden-Spatz Syndrome.

Additional neurologic diseases which can be treated or detected with fusion proteins of the invention and/or polynucleotides encoding albumin fusion proteins of the invention include hydrocephalus such as Dandy-Walker Syndrome and normal pressure hydrocephalus, hypothalamic diseases such as hypothalamic neoplasms, cerebral malaria, narcolepsy which includes cataplexy, bulbar poliomyelitis, cerebri pseudotumor, Rett Syndrome, Reye's Syndrome, thalamic diseases, cerebral toxoplasmosis, intracranial tuberculoma and Zellweger Syndrome, central nervous system infections such as AIDS Dementia Complex, Brain Abscess, subdural empyema, encephalomyelitis such as Equine Encephalomyelitis, Venezuelan Equine Encephalomyelitis, Necrotizing Hemorrhagic Encephalomyelitis, Visna, and cerebral malaria.

Additional neurologic diseases which can be treated or detected with fusion proteins of the invention and/or polynucleotides encoding albumin fusion proteins of the invention include meningitis such as arachnoiditis, aseptic meningtitis such as viral meningtitis which includes lymphocytic choriomeningitis, Bacterial meningtitis which includes *Haemophilus* Meningtitis, *Listeria* Meningtitis, Meningococcal Meningtitis such as Waterhouse-Friderichsen Syndrome, Pneumococcal Meningtitis and meningeal tuberculosis, fungal meningitis such as Cryptococcal Meningtitis, subdural effusion, meningoencephalitis such as uvemeningoencephalitic syndrome, myelitis such as transverse myelitis, neurosyphilis such as tabes dorsalis, poliomyelitis which includes bulbar poliomyelitis and postpoliomyelitis syndrome, prion diseases (such as Creutzfeldt-Jakob Syndrome, Bovine Spongiform Encephalopathy, Gerstmann-Straussler Syndrome, Kuru, Scrapie), and cerebral toxoplasmosis.

Additional neurologic diseases which can be treated or detected with fusion proteins of the invention and/or polynucleotides encoding albumin fusion proteins of the invention include central nervous system neoplasms such as brain neoplasms that include cerebellar neoplasms such as infratentorial neoplasms, cerebral ventricle neoplasms such as choroid plexus neoplasms, hypothalamic neoplasms and supratentorial neoplasms, meningeal neoplasms, spinal cord neoplasms which include epidural neoplasms, demyelinating diseases such as Canavan Diseases, diffuse cerebral sceloris which includes adrenoleukodystrophy, encephalitis periaxialis, globoid cell leukodystrophy, diffuse cerebral sclerosis such as metachromatic leukodystrophy, allergic encephalomyelitis, necrotizing hemorrhagic encephalomyelitis, progressive multifocal leukoencephalopathy, multiple sclerosis, central pontine myelinolysis, transverse myelitis, neuromyelitis optica, Scrapie, Swayback, Chronic Fatigue Syndrome, Visna, High Pressure Nervous Syndrome, Meningism, spinal cord diseases such as amyotonia congenita, amyotrophic lateral sclerosis, spinal muscular atrophy such as Werdnig-Hoffmann Disease, spinal cord compression, spinal cord neoplasms such as epidural neoplasms, syringomyelia, Tabes Dorsalis, Stiff-Man Syndrome, mental retardation such as Angelman Syndrome, Cri-du-Chat Syndrome, De Lange's Syndrome, Down Syndrome, Gangliosidoses such as gangliosidoses G(M1), Sandhoff Disease, Tay-Sachs Disease, Hartnup Disease, homocystinuria, Laurence-Moon-Biedl Syndrome, Lesch-Nyhan Syndrome, Maple Syrup Urine Disease, mucolipidosis such as fucosidosis, neuronal ceroid-lipofuscinosis, oculocerebrorenal syndrome, phenylketonuria such as maternal phenylketonuria, Prader-Willi Syndrome, Rett Syndrome, Rubinstein-Taybi Syndrome, Tuberous Sclerosis, WAGR Syndrome, nervous system abnormalities such as holoprosencephaly, neural tube defects such as anencephaly which includes hydrangencephaly, Arnold-Chairi Deformity, encephalocele, meningocele, meningomyelocele, spinal dysraphism such as spina bifida cystica and spina bifida occulta.

Additional neurologic diseases which can be treated or detected with fusion proteins of the invention and/or polynucleotides encoding albumin fusion proteins of the invention include hereditary motor and sensory neuropathies which include Charcot-Marie Disease, Hereditary optic atrophy, Refsum's Disease, hereditary spastic paraplegia, Werdnig-Hoffmann Disease, Hereditary Sensory and Autonomic Neuropathies such as Congenital Analgesia and Familial Dysautonomia, Neurologic manifestations (such as agnosia that include Gerstmann's Syndrome, Amnesia such as retrograde amnesia, apraxia, neurogenic bladder, cataplexy, communicative disorders such as hearing disorders that includes deafness, partial hearing loss, loudness recruitment and tinnitus, language disorders such as aphasia which include agraphia, anomia, broca aphasia, and Wernicke Aphasia, Dyslexia such as Acquired Dyslexia, language development disorders, speech disorders such as aphasia which includes anomia, broca aphasia and Wernicke Aphasia, articulation disorders, communicative disorders such as speech disorders which include dysarthria, echolalia, mutism and stuttering, voice disorders such as aphonia and hoarseness, decerebrate state, delirium, fasciculation, hallucinations, meningism, movement disorders such as angelman syndrome, ataxia, athetosis, chorea, dystonia, hypokinesia, muscle hypotonia, myoclonus, tic, torticollis and tremor, muscle hypertonia such as muscle rigidity such as stiff-man syndrome, muscle spasticity, paralysis such as facial paralysis which includes Herpes Zoster Oticus, Gastroparesis, Hemiplegia, opthalmoplegia such as diplopia, Duane's Syndrome, Horner's Syndrome, Chronic progressive external opthalmoplegia such as Keams Syndrome, Bulbar Paralysis, Tropical Spastic Paraparesis, Paraplegia such as Brown-Sequard Syndrome, quadriplegia, respiratory paralysis and vocal cord paralysis, paresis, phantom limb, taste disorders such as ageusia and dysgeusia, vision disorders such as amblyopia, blindness, color vision defects, diplopia, hemianopsia, scotoma and subnormal vision, sleep disorders such as hypersomnia which includes Kleine-Levin Syndrome, insomnia, and somnambulism, spasm such as trismus, unconsciousness such as coma, persistent vegetative state and syncope and vertigo, neuromuscular diseases such as amyotonia congenita, amyotrophic lateral sclerosis, Lambert-Eaton Myasthenic Syndrome, motor neuron disease, muscular atrophy such as spinal muscular atrophy, Charcot-Marie Disease and Werdnig-Hoffmann Disease, Postpoliomyelitis Syndrome, Muscular Dystrophy, Myasthenia Gravis, Myotonia Atrophica, Myotonia Confenita, Nemaline Myopathy, Familial Periodic Paralysis, Multiplex Paramyloclonus, Tropical Spastic Paraparesis and Stiff-Man Syndrome, peripheral nervous system diseases such as acrodynia, amyloid neuropathies, autonomic nervous system diseases such as Adie's Syndrome, Barre-Lieou Syndrome, Familial Dysautonomia, Horner's Syndrome, Reflex Sympathetic Dystrophy and Shy-Drager Syndrome, Cranial Nerve Diseases such as Acoustic Nerve Diseases such as Acoustic Neuroma which includes Neurofibromatosis 2, Facial Nerve Diseases such as Facial Neuralgia, Melkersson-Rosenthal Syndrome, ocular motility disorders which includes amblyopia, nystagmus, oculomotor nerve paralysis, opthalmoplegia such as Duane's Syndrome, Horner's Syndrome, Chronic Progressive External Opthalmoplegia which includes Keams Syndrome, Strabismus such as Esotropia and Exotropia, Oculomotor Nerve Paralysis, Optic Nerve Diseases such as Optic Atrophy which includes Hereditary Optic Atrophy, Optic Disk Drusen, Optic Neuritis such as Neuromyelitis Optica, Papilledema, Trigeminal Neuralgia, Vocal Cord Paralysis, Demyelinating Diseases such as Neuromyelitis Optica and Swayback, and Diabetic neuropathies such as diabetic foot.

Additional neurologic diseases which can be treated or detected with fusion proteins of the invention and/or polynucleotides encoding albumin fusion proteins of the invention include nerve compression syndromes such as carpal tunnel syndrome, tarsal tunnel syndrome, thoracic outlet syndrome such as cervical rib syndrome, ulnar nerve compression syndrome, neuralgia such as causalgia, cervico-brachial neuralgia, facial neuralgia and trigeminal neuralgia, neuritis such as experimental allergic neuritis, optic neuritis, polyneuritis, polyradiculoneuritis and radiculities such as polyradiculitis, hereditary motor and sensory neuropathies such as Charcot-Marie Disease, Hereditary Optic Atrophy, Refsum's Disease, Hereditary Spastic Paraplegia and Werdnig-Hoffmann Disease, Hereditary Sensory and Autonomic Neuropathies which include Congenital Analgesia and Familial Dysautonomia, POEMS Syndrome, Sciatica, Gustatory Sweating and Tetany).

Endocrine Disorders

Albumin fusion proteins of the invention and/or polynucleotides encoding albumin fusion proteins of the invention, may be used to treat, prevent, diagnose, and/or prognose disorders and/or diseases related to hormone imbalance, and/or disorders or diseases of the endocrine system.

Hormones secreted by the glands of the endocrine system control physical growth, sexual function, metabolism, and other functions. Disorders may be classified in two ways:

disturbances in the production of hormones, and the inability of tissues to respond to hormones. The etiology of these hormone imbalance or endocrine system diseases, disorders or conditions may be genetic, somatic, such as cancer and some autoimmune diseases, acquired (e.g., by chemotherapy, injury or toxins), or infectious. Moreover, fusion proteins of the invention and/or polynucleotides encoding albumin fusion proteins of the invention can be used as a marker or detector of a particular disease or disorder related to the endocrine system and/or hormone imbalance.

Endocrine system and/or hormone imbalance and/or diseases encompass disorders of uterine motility including, but not limited to: complications with pregnancy and labor (e.g., pre-term labor, post-term pregnancy, spontaneous abortion, and slow or stopped labor); and disorders and/or diseases of the menstrual cycle (e.g., dysmenorrhea and endometriosis).

Endocrine system and/or hormone imbalance disorders and/or diseases include disorders and/or diseases of the pancreas, such as, for example, diabetes mellitus, diabetes insipidus, congenital pancreatic agenesis, pheochromocytoma—islet cell tumor syndrome; disorders and/or diseases of the adrenal glands such as, for example, Addison's Disease, corticosteroid deficiency, virilizing disease, hirsutism, Cushing's Syndrome, hyperaldosteronism, pheochromocytoma; disorders and/or diseases of the pituitary gland, such as, for example, hyperpituitarism, hypopituitarism, pituitary dwarfism, pituitary adenoma, panhypopituitarism, acromegaly, gigantism; disorders and/or diseases of the thyroid, including but not limited to, hyperthyroidism, hypothyroidism, Plummer's disease, Graves' disease (toxic diffuse goiter), toxic nodular goiter, thyroiditis (Hashimoto's thyroiditis, subacute granulomatous thyroiditis, and silent lymphocytic thyroiditis), Pendred's syndrome, myxedema, cretinism, thyrotoxicosis, thyroid hormone coupling defect, thymic aplasia, Hurthle cell tumours of the thyroid, thyroid cancer, thyroid carcinoma, Medullary thyroid carcinoma; disorders and/or diseases of the parathyroid, such as, for example, hyperparathyroidism, hypoparathyroidism; disorders and/or diseases of the hypothalamus.

In addition, endocrine system and/or hormone imbalance disorders and/or diseases may also include disorders and/or diseases of the testes or ovaries, including cancer. Other disorders and/or diseases of the testes or ovaries further include, for example, ovarian cancer, polycystic ovary syndrome, Klinefelter's syndrome, vanishing testes syndrome (bilateral anorchia), congenital absence of Leydig's cells, cryptorchidism, Noonan's syndrome, myotonic dystrophy, capillary haemangioma of the testis (benign), neoplasias of the testis and neo-testis.

Moreover, endocrine system and/or hormone imbalance disorders and/or diseases may also include disorders and/or diseases such as, for example, polyglandular deficiency syndromes, pheochromocytoma, neuroblastoma, multiple Endocrine neoplasia, and disorders and/or cancers of endocrine tissues.

In another embodiment, albumin fusion proteins of the invention and/or polynucleotides encoding albumin fusion proteins of the invention, may be used to diagnose, prognose, prevent, and/or treat endocrine diseases and/or disorders associated with the tissue(s) in which the Therapeutic protein corresponding to the Therapeutic protein portion of the albumin protein of the invention is expressed, Reproductive System Disorders The albumin fusion proteins of the invention and/or polynucleotides encoding albumin fusion proteins of the invention may be used for the diagnosis, treatment, or prevention of diseases and/or disorders of the reproductive system. Reproductive system disorders that can be treated by the compositions of the invention, include, but are not limited to, reproductive system injuries, infections, neoplastic disorders, congenital defects, and diseases or disorders which result in infertility, complications with pregnancy, labor, or parturition, and postpartum difficulties.

Reproductive system disorders and/or diseases include diseases and/or disorders of the testes, including testicular atrophy, testicular feminization, cryptorchism (unilateral and bilateral), anorchia, ectopic testis, epididymitis and orchitis (typically resulting from infections such as, for example, gonorrhea, mumps, tuberculosis, and syphilis), testicular torsion, vasitis nodosa, germ cell tumors (e.g., seminomas, embryonal cell carcinomas, teratocarcinomas, choriocarcinomas, yolk sac tumors, and teratomas), stromal tumors (e.g., Leydig cell tumors), hydrocele, hematocele, varicocele, spermatocele, inguinal hernia, and disorders of sperm production (e.g., immotile cilia syndrome, aspermia, asthenozoospermia, azoospermia, oligospermia, and teratozoospermia).

Reproductive system disorders also include disorders of the prostate gland, such as acute non-bacterial prostatitis, chronic non-bacterial prostatitis, acute bacterial prostatitis, chronic bacterial prostatitis, prostatodystonia, prostatosis, granulomatous prostatitis, malacoplakia, benign prostatic hypertrophy or hyperplasia, and prostate neoplastic disorders, including adenocarcinomas, transitional cell carcinomas, ductal carcinomas, and squamous cell carcinomas.

Additionally, the compositions of the invention may be useful in the diagnosis, treatment, and/or prevention of disorders or diseases of the penis and urethra, including inflammatory disorders, such as balanoposthitis, balanitis xerotica obliterans, phimosis, paraphimosis, syphilis, herpes simplex virus, gonorrhea, non-gonococcal urethritis, chlamydia, mycoplasma, trichomonas, HIV, AIDS, Reiter's syndrome, condyloma acuminatum, condyloma latum, and pearly penile papules; urethral abnormalities, such as hypospadias, epispadias, and phimosis; premalignant lesions, including Erythroplasia of Queyrat, Bowen's disease, Bowenoid paplosis, giant condyloma of Buscke-Lowenstein, and varrucous carcinoma; penile cancers, including squamous cell carcinomas, carcinoma in situ, verrucous carcinoma, and disseminated penile carcinoma; urethral neoplastic disorders, including penile urethral carcinoma, bulbomembranous urethral carcinoma, and prostatic urethral carcinoma; and erectile disorders, such as priapism, Peyronie's disease, erectile dysfunction, and impotence.

Moreover, diseases and/or disorders of the vas deferens include vasculititis and CBAVD (congenital bilateral absence of the vas deferens); additionally, the albumin fusion proteins of the invention and/or polynucleotides encoding albumin fusion proteins of the invention may be used in the diagnosis, treatment, and/or prevention of diseases and/or disorders of the seminal vesicles, including hydatid disease, congenital chloride diarrhea, and polycystic kidney disease.

Other disorders and/or diseases of the male reproductive system include, for example, Klinefelter's syndrome, Young's syndrome, premature ejaculation, diabetes mellitus, cystic fibrosis, Kartagener's syndrome, high fever, multiple sclerosis, and gynecomastia.

Further, the polynucleotides, fusion proteins of the invention and/or polynucleotides encoding albumin fusion proteins of the invention may be used in the diagnosis, treatment, and/or prevention of diseases and/or disorders of the vagina and vulva, including bacterial vaginosis, candida vaginitis, herpes simplex virus, chancroid, granuloma inguinale, lymphogranuloma venereum, scabies, human papillomavirus, vaginal trauma, vulvar trauma, adenosis, chlamydia vaginitis, gonorrhea, trichomonas vaginitis, condyloma acuminatum, syphilis, molluscum contagiosum, atrophic vaginitis, Paget's disease, lichen sclerosus, lichen planus, vulvodynia, toxic shock syndrome, vaginismus, vulvovaginitis, vulvar vestibulitis, and neoplastic disorders, such as squamous cell hyperplasia, clear cell carcinoma, basal cell carcinoma, melanomas, cancer of Bartholin's gland, and vulvar intraepithelial neoplasia.

Disorders and/or diseases of the uterus include dysmenorrhea, retroverted uterus, endometriosis, fibroids, adenomyosis, anovulatory bleeding, amenorrhea, Cushing's syndrome, hydatidiform moles, Asherman's syndrome, premature menopause, precocious puberty, uterine polyps, dysfunctional uterine bleeding (e.g., due to aberrant hormonal signals), and neoplastic disorders, such as adenocarcinomas, keiomyosarcomas, and sarcomas. Additionally, the albumin fusion proteins of the invention and/or polynucleotides encoding albumin fusion proteins of the invention may be useful as a marker or detector of, as well as in the diagnosis, treatment, and/or prevention of congenital uterine abnormalities, such as bicornuate uterus, septate uterus, simple unicornuate uterus, unicornuate uterus with a noncavitary rudimentary horn, unicornuate uterus with a non-communicating cavitary rudimentary horn, unicornuate uterus with a communicating cavitary horn, arcuate uterus, uterine didelfus, and T-shaped uterus.

Ovarian diseases and/or disorders include anovulation, polycystic ovary syndrome (Stein-Leventhal syndrome), ovarian cysts, ovarian hypofunction, ovarian insensitivity to gonadotropins, ovarian overproduction of androgens, right ovarian vein syndrome, amenorrhea, hirutism, and ovarian cancer (including, but not limited to, primary and secondary cancerous growth, Sertoli-Leydig tumors, endometriod carcinoma of the ovary, ovarian papillary serous adenocarcinoma, ovarian mucinous adenocarcinoma, and Ovarian Krukenberg tumors).

Cervical diseases and/or disorders include cervicitis, chronic cervicitis, mucopurulent cervicitis, cervical dysplasia, cervical polyps, Nabothian cysts, cervical erosion, cervical incompetence, and cervical neoplasms (including, for example, cervical carcinoma, squamous metaplasia, squamous cell carcinoma, adenosquamous cell neoplasia, and columnar cell neoplasia).

Additionally, diseases and/or disorders of the reproductive system include disorders and/or diseases of pregnancy, including miscarriage and stillbirth, such as early abortion, late abortion, spontaneous abortion, induced abortion, therapeutic abortion, threatened abortion, missed abortion, incomplete abortion, complete abortion, habitual abortion, missed abortion, and septic abortion; ectopic pregnancy, anemia, Rh incompatibility, vaginal bleeding during pregnancy, gestational diabetes, intrauterine growth retardation, polyhydramnios, HELLP syndrome, abruptio placentae, placenta previa, hyperemesis, preeclampsia, eclampsia, herpes gestationis, and urticaria of pregnancy. Additionally, the albumin fusion proteins of the invention and/or polynucleotides encoding albumin fusion proteins of the invention may be used in the diagnosis, treatment, and/or prevention of diseases that can complicate pregnancy, including heart disease, heart failure, rheumatic heart disease, congenital heart disease, mitral valve prolapse, high blood pressure, anemia, kidney disease, infectious disease (e.g., rubella, cytomegalovirus, toxoplasmosis, infectious hepatitis, chlamydia, HIV, AIDS, and genital herpes), diabetes mellitus, Graves' disease, thyroiditis, hypothyroidism, Hashimoto's thyroiditis, chronic active hepatitis, cirrhosis of the liver, primary biliary cirrhosis, asthma, systemic lupus eryematosis, rheumatoid arthritis, myasthenia gravis, idiopathic thrombocytopenic purpura, appendicitis, ovarian cysts, gallbladder disorders, and obstruction of the intestine.

Complications associated with labor and parturition include premature rupture of the membranes, pre-term labor, post-term pregnancy, postmaturity, labor that progresses too slowly, fetal distress (e.g., abnormal heart rate (fetal or maternal), breathing problems, and abnormal fetal position), shoulder dystocia, prolapsed umbilical cord, amniotic fluid embolism, and aberrant uterine bleeding.

Further, diseases and/or disorders of the postdelivery period, including endometritis, myometritis, parametritis, peritonitis, pelvic thrombophlebitis, pulmonary embolism, endotoxemia, pyelonephritis, saphenous thrombophlebitis, mastitis, cystitis, postpartum hemorrhage, and inverted uterus.

Other disorders and/or diseases of the female reproductive system that may be diagnosed, treated, and/or prevented by the albumin fusion proteins of the invention and/or polynucleotides encoding albumin fusion proteins of the invention include, for example, Turner's syndrome, pseudohermaphroditism, premenstrual syndrome, pelvic inflammatory disease, pelvic congestion (vascular engorgement), frigidity, anorgasmia, dyspareunia, ruptured fallopian tube, and Mittelschmerz.

Infectious Disease

Albumin fusion proteins of the invention and/or polynucleotides encoding albumin fusion proteins of the invention can be used to treat or detect infectious agents. For example, by increasing the immune response, particularly increasing the proliferation and differentiation of B and/or T cells, infectious diseases may be treated. The immune response may be increased by either enhancing an existing immune response, or by initiating a new immune response. Alternatively, fusion proteins of the invention and/or polynucleotides encoding albumin fusion proteins of the invention may also directly inhibit the infectious agent, without necessarily eliciting an immune response.

Viruses are one example of an infectious agent that can cause disease or symptoms that can be treated or detected by albumin fusion proteins of the invention and/or polynucleotides encoding albumin fusion proteins of the invention. Examples of viruses, include, but are not limited to Examples of viruses, include, but are not limited to the following DNA and RNA viruses and viral families: Arbovirus, Adenoviridae, Arenaviridae, Arterivirus, Birnaviridae, Bunyaviridae, Caliciviridae, Circoviridae, Coronaviridae, Dengue, EBV, HIV, Flaviviridae, Hepadnaviridae (Hepatitis), Herpesviridae (such as, Cytomegalovirus, Herpes Simplex, Herpes Zoster), Mononegavirus (e.g., Paramyxoviridae, Morbillivirus, Rhabdoviridae), Orthomyxoviridae (e.g., Influenza A, Influenza B, and parainfluenza), Papiloma virus, Papovaviridae, Parvoviridae, Picornaviridae, Poxyiridae (such as Smallpox or Vaccinia), Reoviridae (e.g., Rotavirus), Retroviridae (HTLV-I, HTLV-II, Lentivirus), and Togaviridae (e.g., Rubivirus). Viruses falling within these families can cause a variety of diseases or symptoms, including, but not limited to: arthritis, bronchiollitis, respiratory syncytial virus, encephalitis, eye infections (e.g., conjunctivitis, keratitis), chronic fatigue syndrome, hepatitis (A, B, C, E, Chronic Active, Delta), Japanese B encephalitis, Junin, Chikungunya, Rift Valley fever, yellow fever, meningitis, opportunistic infections (e.g., AIDS), pneumonia, Burkitt's Lymphoma, chickenpox, hemorrhagic fever, Measles, Mumps, Parainfluenza, Rabies, the common cold, Polio, leukemia, Rubella, sexually transmitted diseases, skin diseases (e.g., Kaposi's, warts), and viremia. Albumin fusion proteins of the invention and/or polynucleotides encoding albumin fusion proteins of the invention, can be used to treat or detect any of these symptoms or diseases. In specific embodiments, fusion proteins of the invention and/or polynucleotides encoding albumin fusion proteins of the invention are used to treat: meningitis, Dengue, EBV, and/or hepatitis (e.g., hepatitis B). In an additional specific embodiment fusion proteins of the invention and/or polynucleotides encoding albumin fusion proteins of the invention are used to treat patients nonresponsive to one or more other commercially available hepatitis vaccines. In a further specific embodiment fusion proteins of the invention and/or polynucleotides encoding albumin fusion proteins of the invention are used to treat AIDS.

Similarly, bacterial and fungal agents that can cause disease or symptoms and that can be treated or detected by albumin fusion proteins of the invention and/or polynucleotides encoding albumin fusion proteins of the invention include, but not limited to, the following Gram-Negative and Gram-positive bacteria, bacterial families, and fungi: *Actinomyces* (e.g., *Norcardia*), *Acinetobacter, Cryptococcus neoformans, Aspergillus*, Bacillaceae (e.g., *Bacillus anthrasis*), *Bacteroides* (e.g., *Bacteroides fragilis*), Blastomycosis, *Bordetella, Borrelia* (e.g., *Borrelia burgdorferi*), *Brucella, Candidia, Campylobacter, Chlamydia, Clostridium* (e.g., *Clostridium botulinum, Clostridium dificile, Clostridium perfringens, Clostridium tetani*), *Coccidioides, Corynebacterium* (e.g., *Corynebacterium diptheriae*), *Cryptococcus*, Dermatocycoses, *E. coli* (e.g., Enterotoxigenic *E. coli* and Enterohemorrhagic *E. coli*), *Enterobacter* (e.g. *Enterobacter aerogenes*), Enterobacteriaceae (*Klebsiella, Salmonella* (e.g., *Salmonella typhi, Salmonella enteritidis, Salmonella typhi*), *Serratia, Yersinia, Shigella*), *Erysipelothrix, Haemophilus* (e.g., *Haemophilus influenza* type B), *Helicobacter, Legionella* (e.g., *Legionella pneumophila*), *Leptospira, Listeria* (e.g., *Listeria monocytogenes*), *Mycoplasma, Mycobacterium* (e.g., *Mycobacterium leprae* and *Mycobacterium tuberculosis*), *Vibrio* (e.g., *Vibrio cholerae*), Neisseriaceae (e.g., *Neisseria gonorrhea, Neisseria meningitidis*), Pasteurellacea, *Proteus, Pseudomonas* (e.g., *Pseudomonas aeruginosa*), Rickettsiaceae, Spirochetes (e.g., *Treponema* spp., *Leptospira* spp., *Borrelia* spp.), *Shigella* spp., *Staphylococcus* (e.g., *Staphylococcus aureus*), *Meningiococcus, Pneumococcus* and *Streptococcus* (e.g., *Streptococcus pneumoniae* and Groups A, B, and C Streptococci), and Ureaplasmas. These bacterial, parasitic, and fungal families can cause diseases or symptoms, including, but not limited to: antibiotic-resistant infections, bacteremia, endocarditis, septicemia, eye infections (e.g., conjunctivitis), uveitis, tuberculosis, gingivitis, bacterial diarrhea, opportunistic infections (e.g., AIDS related infections), paronychia, prosthesis-related infections, dental caries, Reiter's Disease, respiratory tract infections, such as Whooping Cough or Empyema, sepsis, Lyme Disease, Cat-Scratch Disease, dysentery, paratyphoid fever, food poisoning, *Legionella* disease, chronic and acute inflammation, erythema, yeast infections, typhoid, pneumonia, gonorrhea, meningitis (e.g., mengitis types A and B), chlamydia, syphillis, diphtheria, leprosy, brucellosis, peptic ulcers, anthrax, spontaneous abortions, birth defects, pneumonia, lung infections, ear infections, deafness, blindness, lethargy, malaise, vomiting, chronic diarrhea, Crohn's disease, colitis, vaginosis, sterility, pelvic inflammatory diseases, candidiasis, paratuberculosis, tuberculosis, lupus, botulism, gangrene, tetanus, impetigo, Rheumatic Fever, Scarlet Fever, sexually transmitted diseases, skin diseases (e.g., cellulitis, dermatocycoses), toxemia, urinary tract infections, wound infections, noscomial infections. Albumin fusion proteins of the invention and/or polynucleotides encoding albumin fusion proteins of the invention, can be used to treat or detect any of these symptoms or diseases. In specific embodiments, fusion proteins of the invention and/or polynucleotides encoding albumin fusion proteins of the invention are used to treat: tetanus, diptheria, botulism, and/or meningitis type B.

Moreover, parasitic agents causing disease or symptoms that can be treated, prevented, and/or diagnosed by fusion proteins of the invention and/or polynucleotides encoding albumin fusion proteins of the invention include, but not limited to, the following families or class: Amebiasis, Babesiosis, Coccidiosis, Cryptosporidiosis, Dientamoebiasis, Dourine, Ectoparasitic, Giardias, Helminthiasis, Leishmaniasis, Schistisoma, Theileriasis, Toxoplasmosis, Trypanosomiasis, and Trichomonas and Sporozoans (e.g., *Plasmodium virax, Plasmodium falciparium, Plasmodium malariae* and *Plasmodium ovale*). These parasites can cause a variety of diseases or symptoms, including, but not limited to: Scabies, Trombiculiasis, eye infections, intestinal disease (e.g., dysentery, giardiasis), liver disease, lung disease, opportunistic infections (e.g., AIDS related), malaria, pregnancy complications, and toxoplasmosis. Albumin fusion proteins of the invention and/or polynucleotides encoding albumin fusion proteins of the invention, can be used to treat, prevent, and/or diagnose any of these symptoms or diseases. In specific embodiments, fusion proteins of the invention and/or polynucleotides encoding albumin fusion proteins of the invention are used to treat, prevent, and/or diagnose malaria.

Albumin fusion proteins of the invention and/or polynucleotides encoding albumin fusion proteins of the invention could either be by administering an effective amount of an albumin fusion protein of the invention to the patient, or by removing cells from the patient, supplying the cells with a polynucleotide of the present invention, and returning the engineered cells to the patient (ex vivo therapy). Moreover, the albumin fusion proteins of the invention and/or polynucleotides encoding albumin fusion proteins of the invention can be used as an antigen in a vaccine to raise an immune response against infectious disease.

Regeneration

Albumin fusion proteins of the invention and/or polynucleotides encoding albumin fusion proteins of the invention can be used to differentiate, proliferate, and attract cells, leading to the regeneration of tissues. (See, Science 276:59-87 (1997)). The regeneration of tissues could be used to repair, replace, or protect tissue damaged by congenital defects, trauma (wounds, burns, incisions, or ulcers), age, disease (e.g. osteoporosis, osteocarthritis, periodontal disease, liver failure), surgery, including cosmetic plastic surgery, fibrosis, reperfusion injury, or systemic cytokine damage.

Tissues that could be regenerated using the present invention include organs (e.g., pancreas, liver, intestine, kidney, skin, endothelium), muscle (smooth, skeletal or cardiac), vasculature (including vascular and lymphatics), nervous, hematopoietic, and skeletal (bone, cartilage, tendon, and ligament) tissue. Preferably, regeneration occurs without or decreased scarring. Regeneration also may include angiogenesis.

Moreover, fusion proteins of the invention and/or polynucleotides encoding albumin fusion proteins of the invention, may increase regeneration of tissues difficult to heal. For example, increased tendon/ligament regeneration would quicken recovery time after damage. Albumin fusion proteins of the invention and/or polynucleotides encoding albumin fusion proteins of the invention could also be used prophylactically in an effort to avoid damage. Specific diseases that could be treated include of tendinitis, carpal tunnel syndrome, and other tendon or ligament defects. A further example of tissue regeneration of non-healing wounds includes pressure ulcers, ulcers associated with vascular insufficiency, surgical, and traumatic wounds.

Similarly, nerve and brain tissue could also be regenerated by using fusion proteins of the invention and/or polynucleotides encoding albumin fusion proteins of the invention, to proliferate and differentiate nerve cells. Diseases that could be treated using this method include central and peripheral nervous system diseases, neuropathies, or mechanical and traumatic disorders (e.g., spinal cord disorders, head trauma, cerebrovascular disease, and stoke). Specifically, diseases associated with peripheral nerve injuries, peripheral neuropathy (e.g., resulting from chemotherapy or other medical therapies), localized neuropathies, and central nervous system diseases (e.g., Alzheimer's disease, Parkinson's disease, Huntington's disease, amyotrophic lateral sclerosis, and Shy-Drager syndrome), could all be treated using the albumin fusion proteins of the invention and/or polynucleotides encoding albumin fusion proteins of the invention.

Gastrointestinal Disorders

Albumin fusion proteins of the invention and/or polynucleotides encoding albumin fusion proteins of the invention, may be used to treat, prevent, diagnose, and/or prognose gastrointestinal disorders, including inflammatory diseases and/or conditions, infections, cancers (e.g., intestinal neoplasms (carcinoid tumor of the small intestine, non-Hodgkin's lymphoma of the small intestine, small bowl lymphoma)), and ulcers, such as peptic ulcers.

Gastrointestinal disorders include dysphagia, odynophagia, inflammation of the esophagus, peptic esophagitis, gastric reflux, submucosal fibrosis and stricturing, Mallory-Weiss lesions, leiomyomas, lipomas, epidermal cancers, adeoncarcinomas, gastric retention disorders, gastroenteritis, gastric atrophy, gastric/stomach cancers, polyps of the stomach, autoimmune disorders such as pernicious anemia, pyloric stenosis, gastritis (bacterial, viral, eosinophilic, stress-induced, chronic erosive, atrophic, plasma cell, and Ménétrier's), and peritoneal diseases (e.g., chyloperioneum, hemoperitoneum, mesenteric cyst, mesenteric lymphadenitis, mesenteric vascular occlusion, panniculitis, neoplasms, peritonitis, pneumoperitoneum, bubphrenic abscess,).

Gastrointestinal disorders also include disorders associated with the small intestine, such as malabsorption syndromes, distension, irritable bowel syndrome, sugar intolerance, celiac disease, duodenal ulcers, duodenitis, tropical sprue, Whipple's disease, intestinal lymphangiectasia, Crohn's disease, appendicitis, obstructions of the ileum, Meckel's diverticulum, multiple diverticula, failure of complete rotation of the small and large intestine, lymphoma, and bacterial and parasitic diseases (such as Traveler's diarrhea, typhoid and paratyphoid, cholera, infection by Roundworms (*Ascariasis lumbricoides*), Hookworms (*Ancylostoma duodenale*), Threadworms (*Enterobius vermicularis*), Tapeworms (*Taenia saginata, Echinococcus granulosus, Diphyllobothrium* spp., and *T. solium*).

Liver diseases and/or disorders include intrahepatic cholestasis (alagille syndrome, biliary liver cirrhosis), fatty liver (alcoholic fatty liver, reye syndrome), hepatic vein thrombosis, hepatolentricular degeneration, hepatomegaly, hepatopulmonary syndrome, hepatorenal syndrome, portal hypertension (esophageal and gastric varices), liver abscess (amebic liver abscess), liver cirrhosis (alcoholic, biliary and experimental), alcoholic liver diseases (fatty liver, hepatitis, cirrhosis), parasitic (hepatic echinococcosis, fascioliasis, amebic liver abscess), jaundice (hemolytic, hepatocellular, and cholestatic), cholestasis, portal hypertension, liver enlargement, ascites, hepatitis (alcoholic hepatitis, animal hepatitis, chronic hepatitis (autoimmune, hepatitis B, hepatitis C, hepatitis D, drug induced), toxic hepatitis, viral human hepatitis (hepatitis A, hepatitis B, hepatitis C, hepatitis D, hepatitis E), Wilson's disease, granulomatous hepatitis, secondary biliary cirrhosis, hepatic encephalopathy, portal hypertension, varices, hepatic encephalopathy, primary biliary cirrhosis, primary sclerosing cholangitis, hepatocellular adenoma, hemangiomas, bile stones, liver failure (hepatic encephalopathy, acute liver failure), and liver neoplasms (angiomyolipoma, calcified liver metastases, cystic liver metastases, epithelial tumors, fibrolamellar hepatocarcinoma, focal nodular hyperplasia, hepatic adenoma, hepatobiliary cystadenoma, hepatoblastoma, hepatocellular carcinoma, hepatoma, liver cancer, liver hemangioendothelioma, mesenchymal hamartoma, mesenchymal tumors of liver, nodular regenerative hyperplasia, benign liver tumors (Hepatic cysts [Simple cysts, Polycystic liver disease, Hepatobiliary cystadenoma, Choledochal cyst], Mesenchymal tumors [Mesenchymal hamartoma, Infantile hemangioendothelioma, Hemangioma, Peliosis hepatis, Lipomas, Inflammatory pseudotumor, Miscellaneous], Epithelial tumors [Bile duct epithelium (Bile duct hamartoma, Bile duct adenoma), Hepatocyte (Adenoma, Focal nodular hyperplasia, Nodular regenerative hyperplasia)], malignant liver tumors [hepatocellular, hepatoblastoma, hepatocellular carcinoma, cholangiocellular, cholangiocarcinoma, cystadenocarcinoma, tumors of blood vessels, angiosarcoma, Karposi's sarcoma, hemangioendothelioma, other tumors, embryonal sarcoma, fibrosarcoma, leiomyo sarcoma, rhabdomyosarcoma, carcinosarcoma, teratoma, carcinoid, squamous carcinoma, primary lymphoma]), peliosis hepatis, erythrohepatic porphyria, hepatic porphyria (acute intermittent porphyria, porphyria cutanea tarda), Zellweger syndrome).

Pancreatic diseases and/or disorders include acute pancreatitis, chronic pancreatitis (acute necrotizing pancreatitis, alcoholic pancreatitis), neoplasms (adenocarcinoma of the pancreas, cystadenocarcinoma, insulinoma, gastrinoma, and glucagonoma, cystic neoplasms, islet-cell tumors, pancreoblastoma), and other pancreatic diseases (e.g., cystic fibrosis, cyst (pancreatic pseudocyst, pancreatic fistula, insufficiency)).

Gallbladder diseases include gallstones (cholelithiasis and choledocholithiasis), postcholecystectomy syndrome, diverticulosis of the gallbladder, acute cholecystitis, chronic cholecystitis, bile duct tumors, and mucocele.

Diseases and/or disorders of the large intestine include antibiotic-associated colitis, diverticulitis, ulcerative colitis, acquired megacolon, abscesses, fungal and bacterial infections, anorectal disorders (e.g., fissures, hemorrhoids), colonic diseases (colitis, colonic neoplasms [colon cancer, adenomatous colon polyps (e.g., villous adenoma), colon carcinoma, colorectal cancer], colonic diverticulitis, colonic diverticulosis, megacolon [Hirschsprung disease, toxic megacolon]; sigmoid diseases [proctocolitis, sigmoin neoplasms]), constipation, Crohn's disease, diarrhea (infantile diarrhea, dysentery), duodenal diseases (duodenal neoplasms, duodenal obstruction, duodenal ulcer, duodenitis), enteritis (enterocolitis), HIV enteropathy, ileal diseases (ileal neoplasms, ileitis), immunoproliferative small intestinal disease, inflammatory bowel disease (ulcerative colitis, Crohn's disease), intestinal atresia, parasitic diseases (anisakiasis, balantidiasis, blastocystis infections, cryptosporidiosis, dientamoebiasis, amebic dysentery, giardiasis), intestinal fistula (rectal fistula), intestinal neoplasms (cecal neoplasms, colonic neoplasms, duodenal neoplasms, ileal neoplasms, intestinal polyps, jejunal neoplasms, rectal neoplasms), intestinal obstruction (afferent loop syndrome, duodenal obstruction, impacted feces, intestinal pseudo-obstruction [cecal volvulus], intussusception), intestinal perforation, intestinal polyps (colonic polyps, gardner syndrome, peutz-jeghers syndrome), jejunal diseases (jejunal neoplasms), malabsorption syndromes (blind loop syndrome, celiac disease, lactose intolerance, short bowl syndrome, tropical sprue, whipple's disease), mesenteric vascular occlusion, pneumatosis cystoides intestinalis, protein-losing enteropathies (intestinal lymphagiectasis), rectal diseases (anus diseases, fecal incontinence, hemorrhoids, proctitis, rectal fistula, rectal prolapse, rectocele), peptic ulcer (duodenal ulcer, peptic esophagitis, hemorrhage, perforation, stomach ulcer, Zollinger-Ellison syndrome), postgastrectomy syndromes (dumping syndrome), stomach diseases (e.g., achlorhydria, duodenogastric reflux (bile reflux), gastric antral vascular ectasia, gastric fistula, gastric outlet obstruction, gastritis (atrophic or hypertrophic), gastroparesis, stomach dilatation, stomach diverticulum, stomach neoplasms (gastric cancer, gastric polyps, gastric adenocarcinoma, hyperplastic gastric polyp), stomach rupture, stomach ulcer, stomach volvulus), tuberculosis, visceroptosis, vomiting (e.g., hematemesis, hyperemesis gravidarum, postoperative nausea and vomiting) and hemorrhagic colitis.

Further diseases and/or disorders of the gastrointestinal system include biliary tract diseases, such as, gastroschisis, fistula (e.g., biliary fistula, esophageal fistula, gastric fistula, intestinal fistula, pancreatic fistula), neoplasms (e.g., biliary tract neoplasms, esophageal neoplasms, such as adenocarcinoma of the esophagus, esophageal squamous cell carcinoma, gastrointestinal neoplasms, pancreatic neoplasms, such as adenocarcinoma of the pancreas, mucinous cystic neoplasm of the pancreas, pancreatic cystic neoplasms, pancreatoblastoma, and peritoneal neoplasms), esophageal disease (e.g., bullous diseases, candidiasis, glycogenic acanthosis, ulceration, barrett esophagus varices, atresia, cyst, diverticulum (e.g., Zenker's diverticulum), fistula (e.g., tracheoesophageal fistula), motility disorders (e.g., CREST syndrome, deglutition disorders, achalasia, spasm, gastroesophageal reflux), neoplasms, perforation (e.g., Boerhaave syndrome, Mallory-Weiss syndrome), stenosis, esophagitis, diaphragmatic hernia (e.g., hiatal hernia); gastrointestinal diseases, such as, gastroenteritis (e.g., cholera morbus, norwalk virus infection), hemorrhage (e.g., hematemesis, melena, peptic ulcer hemorrhage), stomach neoplasms (gastric cancer, gastric polyps, gastric adenocarcinoma, stomach cancer)), hernia (e.g., congenital diaphragmatic hernia, femoral hernia, inguinal hernia, obturator hernia, umbilical hernia, ventral hernia), and intestinal diseases (e.g., cecal diseases (appendicitis, cecal neoplasms)).

Chemotaxis

Albumin fusion proteins of the invention and/or polynucleotides encoding albumin fusion proteins of the invention may have chemotaxis activity. A chemotaxic molecule attracts or mobilizes cells (e.g., monocytes, fibroblasts, neutrophils, T-cells, mast cells, eosinophils, epithelial and/or endothelial cells) to a particular site in the body, such as inflammation, infection, or site of hyperproliferation. The mobilized cells can then fight off and/or heal the particular trauma or abnormality.

Albumin fusion proteins of the invention and/or polynucleotides encoding albumin fusion proteins of the invention may increase chemotaxic activity of particular cells. These chemotactic molecules can then be used to treat inflammation, infection, hyperproliferative disorders, or any immune system disorder by increasing the number of cells targeted to a particular location in the body. For example, chemotaxic molecules can be used to treat wounds and other trauma to tissues by attracting immune cells to the injured location. Chemotactic molecules of the present invention can also attract fibroblasts, which can be used to treat wounds.

It is also contemplated that fusion proteins of the invention and/or polynucleotides encoding albumin fusion proteins of the invention may inhibit chemotactic activity. These molecules could also be used to treat disorders. Thus, fusion proteins of the invention and/or polynucleotides encoding albumin fusion proteins of the invention could be used as an inhibitor of chemotaxis.

Binding Activity

Albumin fusion proteins of the invention may be used to screen for molecules that bind to the Therapeutic protein portion of the fusion protein or for molecules to which the Therapeutic protein portion of the fusion protein binds. The binding of the fusion protein and the molecule may activate (agonist), increase, inhibit (antagonist), or decrease activity of the fusion protein or the molecule bound. Examples of such molecules include antibodies, oligonucleotides, proteins (e.g., receptors), or small molecules.

Preferably, the molecule is closely related to the natural ligand of the Therapeutic protein portion of the fusion protein of the invention, e.g., a fragment of the ligand, or a natural substrate, a ligand, a structural or functional mimetic. (See, Coligan et al., Current Protocols in Immunology 1(2): Chapter 5 (1991)). Similarly, the molecule can be closely related to the natural receptor to which the Therapeutic protein portion of an albumin fusion protein of the invention binds, or at least, a fragment of the receptor capable of being bound by the Therapeutic protein portion of an albumin fusion protein of the invention (e.g., active site). In either case, the molecule can be rationally designed using known techniques.

Preferably, the screening for these molecules involves producing appropriate cells which express the albumin fusion proteins of the invention. Preferred cells include cells from mammals, yeast, *Drosophila*, or *E. coli*.

The assay may simply test binding of a candidate compound to an albumin fusion protein of the invention, wherein binding is detected by a label, or in an assay involving competition with a labeled competitor. Further, the assay may test whether the candidate compound results in a signal generated by binding to the fusion protein.

Alternatively, the assay can be carried out using cell-free preparations, fusion protein/molecule affixed to a solid support, chemical libraries, or natural product mixtures. The assay may also simply comprise the steps of mixing a candidate compound with a solution containing an albumin fusion protein, measuring fusion protein/molecule activity or binding, and comparing the fusion protein/molecule activity or binding to a standard.

Preferably, an ELISA assay can measure fusion protein level or activity in a sample (e.g., biological sample) using a monoclonal or polyclonal antibody. The antibody can measure fusion protein level or activity by either binding, directly or indirectly, to the albumin fusion protein or by competing with the albumin fusion protein for a substrate.

Additionally, the receptor to which a Therapeutic protein portion of an albumin fusion protein of the invention binds can be identified by numerous methods known to those of skill in the art, for example, ligand panning and FACS sorting (Coligan, et al., Current Protocols in Immun., 1(2), Chapter 5, (1991)). For example, in cases wherein the Therapeutic protein portion of the fusion protein corresponds to FGF, expression cloning may be employed wherein polyadenylated RNA is prepared from a cell responsive to the albumin fusion protein, for example, NIH3T3 cells which are known to contain multiple receptors for the FGF family proteins, and SC-3 cells, and a cDNA library created from this RNA is divided into pools and used to transfect COS cells or other cells that are not responsive to the albumin fusion protein. Transfected cells which are grown on glass slides are exposed to the albumin fusion protein of the present invention, after they have been labeled. The albumin fusion proteins can be labeled by a variety of means including iodination or inclusion of a recognition site for a site-specific protein kinase.

Following fixation and incubation, the slides are subjected to auto-radiographic analysis. Positive pools are identified and sub-pools are prepared and re-transfected using an iterative sub-pooling and re-screening process, eventually yielding a single clones that encodes the putative receptor.

As an alternative approach for receptor identification, a labeled albumin fusion protein can be photoaffinity linked with cell membrane or extract preparations that express the receptor molecule for the Therapeutoc protein component of an albumin fusion protein of the invention, the linked material may be resolved by PAGE analysis and exposed to X-ray film. The labeled complex containing the receptors of the fusion protein can be excised, resolved into peptide fragments, and subjected to protein microsequencing. The amino acid sequence obtained from microsequencing would be used to design a set of degenerate oligonucleotide probes to screen a cDNA library to identify the genes encoding the putative receptors.

Moreover, the techniques of gene-shuffling, motif-shuffling, exon-shuffling, and/or codon-shuffling (collectively referred to as "DNA shuffling") may be employed to modulate the activities of the fusion protein, and/or Therapeutic protein portion or albumin component of an albumin fusion protein of the present invention, thereby effectively generating agonists and antagonists of an albumin fusion protein of the present invention. See generally, U.S. Pat. Nos. 5,605,793, 5,811,238, 5,830,721, 5,834,252, and 5,837,458, and Patten, P. A., et al., *Curr. Opinion Biotechnol.* 8:724-33 (1997); Harayama, S. *Trends Biotechnol.* 16(2):76-82 (1998); Hansson, L. O., et al., *J. Mol. Biol.* 287:265-76 (1999); and Lorenzo, M. M. and Blasco, R. *Biotechniques* 24(2):308-13 (1998); each of these patents and publications are hereby incorporated by reference). In one embodiment, alteration of polynucleotides encoding albumin fusion proteins of the invention and thus, the albumin fusion proteins encoded thereby, may be achieved by DNA shuffling. DNA shuffling involves the assembly of two or more DNA segments into a desired molecule by homologous, or site-specific, recombination. In another embodiment, polynucleotides encoding albumin fusion proteins of the invention and thus, the albumin fusion proteins encoded thereby, may be altered by being subjected to random mutagenesis by error-prone PCR, random nucleotide insertion or other methods prior to recombination. In another embodiment, one or more components, motifs, sections, parts, domains, fragments, etc., of an albumin fusion protein of the present invention may be recombined with one or more components, motifs, sections, parts, domains, fragments, etc. of one or more heterologous molecules. In preferred embodiments, the heterologous molecules are family members. In further preferred embodiments, the heterologous molecule is a growth factor such as, for example, platelet-derived growth factor (PDGF), insulin-like growth factor (IGF-I), transforming growth factor (TGF)-alpha, epidermal growth factor (EGF), fibroblast growth factor (FGF), TGF-beta, bone morphogenetic protein (BMP)-2, BMP-4, BMP-5, BMP-6, BMP-7, activins A and B, decapentaplegic (dpp), 60A, OP-2, dorsalin, growth differentiation factors (GDFs), nodal, MIS, inhibin-alpha, TGF-beta1, TGF-beta2, TGF-beta3, TGF-beta5, and glial-derived neurotrophic factor (GDNF).

Other preferred fragments are biologically active fragments of the Therapeutic protein portion and/or albumin component of the albumin fusion proteins of the present invention. Biologically active fragments are those exhibiting activity similar, but not necessarily identical, to an activity of a Therapeutic protein portion and/or albumin component of the albumin fusion proteins of the present invention. The biological activity of the fragments may include an improved desired activity, or a decreased undesirable activity.

Additionally, this invention provides a method of screening compounds to identify those which modulate the action of an albumin fusion protein of the present invention. An example of such an assay comprises combining a mammalian fibroblast cell, an albumin fusion protein of the present invention, and the compound to be screened and $^{3}$[H] thymidine under cell culture conditions where the fibroblast cell would normally proliferate. A control assay may be performed in the absence of the compound to be screened and compared to the amount of fibroblast proliferation in the presence of the compound to determine if the compound stimulates proliferation by determining the uptake of $^{3}$[H] thymidine in each case. The amount of fibroblast cell proliferation is measured by liquid scintillation chromatography which measures the incorporation of $^{3}$[H] thymidine. Both agonist and antagonist compounds may be identified by this procedure.

In another method, a mammalian cell or membrane preparation expressing a receptor for the Therapeutic protein component of a fusion protein of the invention is incubated with a labeled fusion protein of the present invention in the presence of the compound. The ability of the compound to enhance or block this interaction could then be measured. Alternatively, the response of a known second messenger system following interaction of a compound to be screened and the receptor is measured and the ability of the compound to bind to the receptor and elicit a second messenger response is measured to determine if the compound is a potential fusion protein. Such second messenger systems include but are not limited to, cAMP guanylate cyclase, ion channels or phosphoinositide hydrolysis.

All of these above assays can be used as diagnostic or prognostic markers. The molecules discovered using these assays can be used to treat disease or to bring about a particular result in a patient (e.g., blood vessel growth) by activating or inhibiting the fusion protein/molecule. Moreover, the assays can discover agents which may inhibit or enhance the production of the albumin fusion proteins of the invention from suitably manipulated cells or tissues.

Therefore, the invention includes a method of identifying compounds which bind to an albumin fusion protein of the invention comprising the steps of: (a) incubating a candidate binding compound with an albumin fusion protein of the present invention; and (b) determining if binding has occurred. Moreover, the invention includes a method of identifying agonists/antagonists comprising the steps of: (a) incubating a candidate compound with an albumin fusion protein of the present invention, (b) assaying a biological activity, and (b) determining if a biological activity of the fusion protein has been altered.

Targeted Delivery

In another embodiment, the invention provides a method of delivering compositions to targeted cells expressing a receptor for a component of an albumin fusion protein of the invention.

As discussed herein, fusion proteins of the invention may be associated with heterologous polypeptides, heterologous nucleic acids, toxins, or prodrugs via hydrophobic, hydrophilic, ionic and/or covalent interactions. In one embodiment, the invention provides a method for the specific delivery of compositions of the invention to cells by administering fusion proteins of the invention (including antibodies) that are associated with heterologous polypeptides or nucleic acids. In one example, the invention provides a method for delivering a Therapeutic protein into the targeted cell. In another example, the invention provides a method for delivering a single stranded nucleic acid (e.g., antisense or ribozymes) or double stranded nucleic acid (e.g., DNA that can integrate into the cell's genome or replicate episomally and that can be transcribed) into the targeted cell.

In another embodiment, the invention provides a method for the specific destruction of cells (e.g., the destruction of tumor cells) by administering an albumin fusion protein of the invention (e.g., polypeptides of the invention or antibodies of the invention) in association with toxins or cytotoxic prodrugs.

By "toxin" is meant compounds that bind and activate endogenous cytotoxic effector systems, radioisotopes, holotoxins, modified toxins, catalytic subunits of toxins, or any molecules or enzymes not normally present in or on the surface of a cell that under defined conditions cause the cell's death. Toxins that may be used according to the methods of the invention include, but are not limited to, radioisotopes known in the art, compounds such as, for example, antibodies (or complement fixing containing portions thereof) that bind an inherent or induced endogenous cytotoxic effector system, thymidine kinase, endonuclease, RNAse, alpha toxin, ricin, abrin, *Pseudomonas* exotoxin A, diphtheria toxin, saporin, momordin, gelonin, pokeweed antiviral protein, alpha-sarcin and cholera toxin. By "cytotoxic prodrug" is meant a non-toxic compound that is converted by an enzyme, normally present in the cell, into a cytotoxic compound. Cytotoxic prodrugs that may be used according to the methods of the invention include, but are not limited to, glutamyl derivatives of benzoic acid mustard alkylating agent, phosphate derivatives of etoposide or mitomycin C, cytosine arabinoside, daunorubisin, and phenoxyacetamide derivatives of doxorubicin.

Drug Screening

Further contemplated is the use of the albumin fusion proteins of the present invention, or the polynucleotides encoding these fusion proteins, to screen for molecules which modify the activities of the albumin fusion protein of the present invention or proteins corresponding to the Therapeutic protein portion of the albumin fusion protein. Such a method would include contacting the fusion protein with a selected compound(s) suspected of having antagonist or agonist activity, and assaying the activity of the fusion protein following binding.

This invention is particularly useful for screening therapeutic compounds by using the albumin fusion proteins of the present invention, or binding fragments thereof, in any of a variety of drug screening techniques. The albumin fusion protein employed in such a test may be affixed to a solid support, expressed on a cell surface, free in solution, or located intracellularly. One method of drug screening utilizes eukaryotic or prokaryotic host cells which are stably transformed with recombinant nucleic acids expressing the albumin fusion protein. Drugs are screened against such transformed cells or supernatants obtained from culturing such cells, in competitive binding assays. One may measure, for example, the formulation of complexes between the agent being tested and an albumin fusion protein of the present invention.

Thus, the present invention provides methods of screening for drugs or any other agents which affect activities mediated by the albumin fusion proteins of the present invention. These methods comprise contacting such an agent with an albumin fusion protein of the present invention or a fragment thereof and assaying for the presence of a complex between the agent and the albumin fusion protein or a fragment thereof, by methods well known in the art. In such a competitive binding assay, the agents to screen are typically labeled. Following incubation, free agent is separated from that present in bound form, and the amount of free or uncomplexed label is a measure of the ability of a particular agent to bind to the albumin fusion protein of the present invention.

Another technique for drug screening provides high throughput screening for compounds having suitable binding affinity to an albumin fusion protein of the present invention, and is described in great detail in European Patent Application 84/03564, published on Sep. 13, 1984, which is incorporated herein by reference herein. Briefly stated, large numbers of different small peptide test compounds are synthesized on a solid substrate, such as plastic pins or some other surface. The peptide test compounds are reacted with an albumin fusion protein of the present invention and washed. Bound peptides are then detected by methods well known in the art. Purified albumin fusion protein may be coated directly onto plates for use in the aforementioned drug screening techniques. In addition, non-neutralizing antibodies may be used to capture the peptide and immobilize it on the solid support.

This invention also contemplates the use of competitive drug screening assays in which neutralizing antibodies capable of binding an albumin fusion protein of the present invention specifically compete with a test compound for binding to the albumin fusion protein or fragments thereof. In this manner, the antibodies are used to detect the presence of any peptide which shares one or more antigenic epitopes with an albumin fusion protein of the invention.

Binding Peptides and Other Molecules

The invention also encompasses screening methods for identifying polypeptides and nonpolypeptides that bind albumin fusion proteins of the invention, and the binding molecules identified thereby. These binding molecules are useful, for example, as agonists and antagonists of the albumin fusion proteins of the invention. Such agonists and antagonists can be used, in accordance with the invention, in the therapeutic embodiments described in detail, below.

This method comprises the steps of: contacting an albumin fusion protein of the invention with a plurality of molecules; and identifying a molecule that binds the albumin fusion protein.

The step of contacting the albumin fusion protein of the invention with the plurality of molecules may be effected in a number of ways. For example, one may contemplate immobilizing the albumin fusion protein on a solid support and bringing a solution of the plurality of molecules in contact with the immobilized polypeptides. Such a procedure would be akin to an affinity chromatographic process, with the affinity matrix being comprised of the immobilized albumin fusion protein of the invention. The molecules having a selective affinity for the albumin fusion protein can then be purified by affinity selection. The nature of the solid support, process for attachment of the albumin fusion protein to the solid support, solvent, and conditions of the affinity isolation or selection are largely conventional and well known to those of ordinary skill in the art.

Alternatively, one may also separate a plurality of polypeptides into substantially separate fractions comprising a subset of or individual polypeptides. For instance, one can separate the plurality of polypeptides by gel electrophoresis, column chromatography, or like method known to those of ordinary skill for the separation of polypeptides. The individual polypeptides can also be produced by a transformed host cell in such a way as to be expressed on or about its outer surface (e.g., a recombinant phage). Individual isolates can then be "probed" by an albumin fusion protein of the invention, optionally in the presence of an inducer should one be required for expression, to determine if any selective affinity interaction takes place between the albumin fusion protein and the individual clone. Prior to contacting the albumin fusion protein with each fraction comprising individual polypeptides, the polypeptides could first be transferred to a solid support for additional convenience. Such a solid support may simply be a piece of filter membrane, such as one made of nitrocellulose or nylon. In this manner, positive clones could be identified from a collection of transformed host cells of an expression library, which harbor a DNA construct encoding a polypeptide having a selective affinity for an albumin fusion protein of the invention. Furthermore, the amino acid sequence of the polypeptide having a selective affinity for an albumin fusion protein of the invention can be determined directly by conventional means or the coding sequence of the DNA encoding the polypeptide can frequently be determined more conveniently. The primary sequence can then be deduced from the corresponding DNA sequence. If the amino acid sequence is to be determined from the polypeptide itself, one may use microsequencing techniques. The sequencing technique may include mass spectroscopy.

In certain situations, it may be desirable to wash away any unbound polypeptides from a mixture of an albumin fusion protein of the invention and the plurality of polypeptides prior to attempting to determine or to detect the presence of a selective affinity interaction. Such a wash step may be particularly desirable when the albumin fusion protein of the invention or the plurality of polypeptides are bound to a solid support.

The plurality of molecules provided according to this method may be provided by way of diversity libraries, such as random or combinatorial peptide or nonpeptide libraries which can be screened for molecules that specifically bind an albumin fusion protein of the invention. Many libraries are known in the art that can be used, e.g., chemically synthesized libraries, recombinant (e.g., phage display libraries), and in vitro translation-based libraries. Examples of chemically synthesized libraries are described in Fodor et al., Science 251:767-773 (1991); Houghten et al., Nature 354:84-86 (1991); Lam et al., Nature 354:82-84 (1991); Medynski, Bio/Technology 12:709-710 (1994); Gallop et al., J. Medicinal Chemistry 37(9):1233-1251 (1994); Ohlmeyer et al., Proc. Natl. Acad. Sci. USA 90:10922-10926 (1993); Erb et al., Proc. Natl. Acad. Sci. USA 91:11422-11426 (1994); Houghten et al., Biotechniques 13:412 (1992); Jayawickreme et al., Proc. Natl. Acad. Sci. USA 91:1614-1618 (1994); Salmon et al., Proc. Natl. Acad. Sci. USA 90:11708-11712 (1993); PCT Publication No. WO 93/20242; and Brenner and Lerner, Proc. Natl. Acad. Sci. USA 89:5381-5383 (1992).

Examples of phage display libraries are described in Scott et al., Science 249:386-390 (1990); Devlin et al., Science, 249:404-406 (1990); Christian et al., 1992, J. Mol. Biol. 227:711-718 1992); Lenstra, J. Immunol. Meth. 152:149-157 (1992); Kay et al., Gene 128:59-65 (1993); and PCT Publication No. WO 94/18318 dated Aug. 18, 1994.

In vitro translation-based libraries include but are not limited to those described in PCT Publication No. WO 91/05058 dated Apr. 18, 1991; and Mattheakis et al., Proc. Natl. Acad. Sci. USA 91:9022-9026 (1994).

By way of examples of nonpeptide libraries, a benzodiazepine library (see e.g., Bunin et al., Proc. Natl. Acad. Sci. USA 91:4708-4712 (1994)) can be adapted for use. Peptoid libraries (Simon et al., Proc. Natl. Acad. Sci. USA 89:9367-9371 (1992)) can also be used. Another example of a library that can be used, in which the amide functionalities in peptides have been permethylated to generate a chemically transformed combinatorial library, is described by Ostresh et al. (Proc. Natl. Acad. Sci. USA 91:11138-11142 (1994)).

The variety of non-peptide libraries that are useful in the present invention is great. For example, Ecker and Crooke (Bio/Technology 13:351-360 (1995) list benzodiazepines, hydantoins, piperazinediones, biphenyls, sugar analogs, beta-mercaptoketones, arylacetic acids, acylpiperidines, benzopyrans, cubanes, xanthines, aminimides, and oxazolones as among the chemical species that form the basis of various libraries.

Non-peptide libraries can be classified broadly into two types: decorated monomers and oligomers. Decorated monomer libraries employ a relatively simple scaffold structure upon which a variety functional groups is added. Often the scaffold will be a molecule with a known useful pharmacological activity. For example, the scaffold might be the benzodiazepine structure.

Non-peptide oligomer libraries utilize a large number of monomers that are assembled together in ways that create new shapes that depend on the order of the monomers. Among the monomer units that have been used are carbamates, pyrrolinones, and morpholinos. Peptoids, peptide-like oligomers in which the side chain is attached to the alpha amino group rather than the alpha carbon, form the basis of another version of non-peptide oligomer libraries. The first non-peptide oligomer libraries utilized a single type of monomer and thus contained a repeating backbone. Recent libraries have utilized more than one monomer, giving the libraries added flexibility. Screening the libraries can be accomplished by any of a variety of commonly known methods. See, e.g., the following references, which disclose screening of peptide libraries: Parmley et al., Adv. Exp. Med. Biol. 251:215-218 (1989); Scott et al., Science 249:386-390 (1990); Fowlkes et al., BioTechniques 13:422-427 (1992); Oldenburg et al., Proc. Natl. Acad. Sci. USA 89:5393-5397 (1992); Yu et al., Cell 76:933-945 (1994); Staudt et al., Science 241:577-580 (1988); Bock et al., Nature 355:564-566 (1992); Tuerk et al., Proc. Natl. Acad. Sci. USA 89:6988-6992 (1992); Ellington et al., Nature 355:850-852 (1992); U.S. Pat. No. 5,096,815, U.S. Pat. No. 5,223,409, and U.S. Pat. No. 5,198,346, all to Ladner et al.; Rebar et al., Science 263:671-673 (1993); and PCT Publication No. WO 94/18318.

In a specific embodiment, screening to identify a molecule that binds an albumin fusion protein of the invention can be carried out by contacting the library members with an albumin fusion protein of the invention immobilized on a solid phase and harvesting those library members that bind to the albumin fusion protein. Examples of such screening methods, termed "panning" techniques are described by way of example in Parmley et al., Gene 73:305-318 (1988); Fowlkes et al., BioTechniques 13:422-427 (1992); PCT Publication No. WO 94/18318; and in references cited herein.

In another embodiment, the two-hybrid system for selecting interacting proteins in yeast (Fields et al., Nature 340:245-246 (1989); Chien et al., Proc. Natl. Acad. Sci. USA 88:9578-9582 (1991) can be used to identify molecules that specifically bind to polypeptides of the invention.

Where the binding molecule is a polypeptide, the polypeptide can be conveniently selected from any peptide library, including random peptide libraries, combinatorial peptide libraries, or biased peptide libraries. The term "biased" is used herein to mean that the method of generating the library is manipulated so as to restrict one or more parameters that govern the diversity of the resulting collection of molecules, in this case peptides.

Thus, a truly random peptide library would generate a collection of peptides in which the probability of finding a particular amino acid at a given position of the peptide is the same for all 20 amino acids. A bias can be introduced into the library, however, by specifying, for example, that a lysine occur every fifth amino acid or that positions 4, 8, and 9 of a decapeptide library be fixed to include only arginine. Clearly, many types of biases can be contemplated, and the present invention is not restricted to any particular bias. Furthermore, the present invention contemplates specific types of peptide libraries, such as phage displayed peptide libraries and those that utilize a DNA construct comprising a lambda phage vector with a DNA insert.

As mentioned above, in the case of a binding molecule that is a polypeptide, the polypeptide may have about 6 to less than about 60 amino acid residues, preferably about 6 to about 10 amino acid residues, and most preferably, about 6 to about 22 amino acids. In another embodiment, a binding polypeptide has in the range of 15-100 amino acids, or 20-50 amino acids.

The selected binding polypeptide can be obtained by chemical synthesis or recombinant expression.

Other Activities

An albumin fusion protein of the invention and/or polynucleotide encoding an albumin fusion protein of the invention, may be employed in treatment for stimulating re-vascularization of ischemic tissues due to various disease conditions such as thrombosis, arteriosclerosis, and other cardiovascular conditions. The albumin fusion proteins of the invention and/or polynucleotides encoding albumin fusion proteins of the invention may also be employed to stimulate angiogenesis and limb regeneration, as discussed above.

An albumin fusion protein of the invention and/or polynucleotide encoding an albumin fusion protein of the invention may also be employed for treating wounds due to injuries, burns, post-operative tissue repair, and ulcers since they are mitogenic to various cells of different origins, such as fibroblast cells and skeletal muscle cells, and therefore, facilitate the repair or replacement of damaged or diseased tissue.

An albumin fusion protein of the invention and/or polynucleotide encoding an albumin fusion protein of the invention may also be employed stimulate neuronal growth and to treat and prevent neuronal damage which occurs in certain neuronal disorders or neuro-degenerative conditions such as Alzheimer's disease, Parkinson's disease, and AIDS-related complex. An albumin fusion protein of the invention and/or polynucleotide encoding an albumin fusion protein of the invention may have the ability to stimulate chondrocyte growth, therefore, they may be employed to enhance bone and periodontal regeneration and aid in tissue transplants or bone grafts.

An albumin fusion protein of the invention and/or polynucleotide encoding an albumin fusion protein of the invention may be also be employed to prevent skin aging due to sunburn by stimulating keratinocyte growth.

An albumin fusion protein of the invention and/or polynucleotide encoding an albumin fusion protein of the invention may also be employed for preventing hair loss. Along the same lines, an albumin fusion protein of the invention and/or polynucleotide encoding an albumin fusion protein of the invention may be employed to stimulate growth and differentiation of hematopoietic cells and bone marrow cells when used in combination with other cytokines.

An albumin fusion protein of the invention and/or polynucleotide encoding an albumin fusion protein of the invention may also be employed to maintain organs before transplantation or for supporting cell culture of primary tissues. An albumin fusion protein of the invention and/or polynucleotide encoding an albumin fusion protein of the invention may also be employed for inducing tissue of mesodermal origin to differentiate in early embryos.

An albumin fusion protein of the invention and/or polynucleotide encoding an albumin fusion protein of the invention may also increase or decrease the differentiation or proliferation of embryonic stem cells, besides, as discussed above, hematopoietic lineage.

An albumin fusion protein of the invention and/or polynucleotide encoding an albumin fusion protein of the invention may also be used to modulate mammalian characteristics, such as body height, weight, hair color, eye color, skin, percentage of adipose tissue, pigmentation, size, and shape (e.g., cosmetic surgery). Similarly, an albumin fusion protein of the invention and/or polynucleotide encoding an albumin fusion protein of the invention may be used to modulate mammalian metabolism affecting catabolism, anabolism, processing, utilization, and storage of energy.

An albumin fusion protein of the invention and/or polynucleotide encoding an albumin fusion protein of the invention may be used to change a mammal's mental state or physical state by influencing biorhythms, caricadic rhythms, depression (including depressive disorders), tendency for violence, tolerance for pain, reproductive capabilities (preferably by Activin or Inhibin-like activity), hormonal or endocrine levels, appetite, libido, memory, stress, or other cognitive qualities.

An albumin fusion protein of the invention and/or polynucleotide encoding an albumin fusion protein of the invention may also be used as a food additive or preservative, such as to increase or decrease storage capabilities, fat content, lipid, protein, carbohydrate, vitamins, minerals, cofactors or other nutritional components.

The above-recited applications have uses in a wide variety of hosts. Such hosts include, but are not limited to, human, murine, rabbit, goat, guinea pig, camel, horse, mouse, rat, hamster, pig, micro-pig, chicken, goat, cow, sheep, dog, cat, non-human primate, and human. In specific embodiments, the host is a mouse, rabbit, goat, guinea pig, chicken, rat, hamster, pig, sheep, dog or cat. In preferred embodiments, the host is a mammal. In most preferred embodiments, the host is a human.

Having generally described the invention, the same will be more readily understood by reference to the following examples, which are provided by way of illustration and are not intended as limiting.

Without further description, it is believed that one of ordinary skill in the art can, using the preceding description and the following illustrative examples, make and utilize the alterations detected in the present invention and practice the claimed methods. The following working examples therefore, specifically point out preferred embodiments of the present invention, and are not to be construed as limiting in any way the remainder of the disclosure.

EXAMPLES

Example 1

Generation of pScNHSA and pScCHSA

The vectors pScNHSA (ATCC™ Deposit No. PTA-3279) and pScCHSA (ATCC™ Deposit No. PTA-3276) are derivatives of pPPC0005 (ATCC™ Deposit No. PTA-3278) and are used as cloning vectors into which polynucleotides encoding a therapeutic protein or fragment or variant thereof is inserted adjacent to and in translation frame with polynucleotides encoding human serum albumin "HSA". pScCHSA may be used for generating Therapeutic protein-HSA fusions, while pScNHSA may be used to generate HSA-Therapeutic protein fusions.

Generation of pScCHSA: Albumin Fusion with the Albumin Moiety C-Terminal to the Therapeutic Portion.

A vector to facilitate cloning DNA encoding a Therapeutic protein N-terminal to DNA encoding the mature albumin protein was made by altering the nucleic acid sequence that encodes the chimeric HSA signal peptide in pPPC0005 to include the Xho I and Cla I restriction sites.

First, the Xho I and Cla I sites inherent to pPPC0005 (located 3' of the ADH1 terminator sequence) were eliminated by digesting pPPC0005 with Xho I and Cla I, filling in the sticky ends with T4 DNA polymerase, and religating the blunt ends to create pPPC0006.

Second, the Xho I and Cla I restriction sites were engineered into the nucleic acid sequence that encodes the signal peptide of HSA (a chimera of the HSA leader and a kex2 site from mating factor alpha, "MAF") in pPPC0006 using two rounds of PCR. In the first round of PCR, amplification with primers shown as SEQ ID NO:36 and SEQ ID NO:37 was performed. The primer whose sequence is shown as SEQ ID NO:36 comprises a nucleic acid sequence that encodes part of the signal peptide sequence of HSA, a kex2 site from the mating factor alpha leader sequence, and part of the amino-terminus of the mature form of HSA. Four point mutations were introduced in the sequence, creating the Xho I and Cla I sites found at the junction of the chimeric signal peptide and the mature form of HSA. These four mutations are underlined in the sequence shown below. In pPPC0005 the nucleotides at these four positions from 5' to 3' are T, G, T, and G. 5'-GCCT CGA GAAAAGAGATGCACACAAGAGTGAGGTTGCTCATCG ATTTAAAGATTTGGG-3' (SEQ ID NO:36) and 5'-AATC-GATGAGCAACCTCACTCTTGTGTG-CATCTCTTTTCTCGAGGCTCCTGGAATAAGC-3' (SEQ ID NO:37). A second round of PCR was then performed with an upstream flanking primer, 5'-TACAAACTTAAGAGTC-CAATTAGC-3' (SEQ ID NO:38) and a downstream flanking primer 5'-CACTTCTCTAGAGTGGTTTCATATGTCTT-3' (SEQ ID NO:39). The resulting PCR product was then purified and digested with Afl II and Xba I and ligated into the same sites in pPPC0006 creating pScCHSA. The resulting plasmid has Xho I and Cla I sites engineered into the signal sequence. The presence of the Xho I site creates a single amino acid change in the end of the signal sequence from LDKR to LEKR. The D to E change will not be present in the final albumin fusion protein expression plasmid when a nucleic acid sequence comprising a polynucleotide encoding the Therapeutic portion of the albumin fusion protein with a 5' Sal I site (which is compatible with the Xho I site) and a 3' Cla I site is ligated into the Xho I and Cla I sites of pScCHSA. Ligation of Sal I to Xho I restores the original amino acid sequence of the signal peptide sequence. DNA encoding the Therapeutic portion of the albumin fusion protein may be inserted after the Kex2 site (Kex2 cleaves after the dibasic amino acid sequence KR at the end of the signal peptide) and prior to the Cla I site.

Generation of pScNHSA: Albumin Fusion with the Albumin Moiety N-Terminal to the Therapeutic Portion.

A vector to facilitate cloning DNA encoding a Therapeutic protein portion C-terminal to DNA encoding the mature albumin protein, was made by adding three, eight-base-pair restriction sites to pScCHSA. The Asc I, Fse I, and Pme I restriction sites were added in between the Bsu36 I and Hind III sites at the end of the nucleic acid sequence encoding the mature HSA protein. This was accomplished through the use of two complementary synthetic primers containing the Asc I, Fse I, and Pme I restriction sites underlined (SEQ ID NO:40 and SEQ ID NO:41). 5'-AAGCTGCCTTAGGCT-TATAATAA GGCGCGCCGGCCGGCCGTTTAAACTAAGCTTAATT CT-3' (SEQ ID NO:40) and 5-AGAATTAAGCTTA GTTTAAACGGCCGGCCGGCGCGCCTTATTATAAGCC TAAGGCAGCTT-3' (SEQ ID NO:41). These primers were annealed and digested with Bsu36 I and Hind III and ligated into the same sites in pScCHSA creating pScNHSA.

Example 2

General Construct Generation for Yeast Transformation

The vectors pScNHSA and pScCHSA may be used as cloning vectors into which polynucleotides encoding a therapeutic protein or fragment or variant thereof is inserted adjacent to polynucleotides encoding mature human serum albumin "HSA". pScCHSA is used for generating Therapeutic protein-HSA fusions, while pScNHSA may be used to generate HSA-Therapeutic protein fusions.

Generation of Albumin Fusion Constructs Comprising HSA-Therapeutic Protein Fusion Products.

DNA encoding a Therapeutic protein (e.g., sequences shown in SEQ ID NO:X or known in the art) may be PCR amplified using the primers which facilitate the generation of a fusion construct (e.g., by adding restriction sites, encoding seamless fusions, encoding linker sequences, etc.) For example, one skilled in the art could design a 5' primer that adds polynucleotides encoding the last four amino acids of the mature form of HSA (and containing the Bsu36I site) onto the 5' end of DNA encoding a Therapeutic protein; and a 3' primer that adds a STOP codon and appropriate cloning sites onto the 3' end of the Therapeutic protein coding sequence. For instance, the forward primer used to amplify DNA encoding a Therapeutic protein might have the sequence, 5'-aagctG CCTTAGGCTTA$(N)_{15}$-3' (SEQ ID NO:42) where the underlined sequence is a Bsu36I site, the upper case nucleotides encode the last four amino acids of the mature HSA protein (ALGL), and $(N)_{15}$ is identical to the first 15 nucleotides encoding the Therapeutic protein of interest. Similarly, the reverse primer used to amplify DNA encoding a Therapeutic protein might have the sequence, 5'-GCGCGCGTTTAAAC GGCCGGCCGCGCCTTATT $(N)_{15}$-3' (SEQ ID NO:43) where the italicized sequence is a Pme I site, the double underlined sequence is an Fse I site, the singly underlined sequence is an Asc I site, the boxed nucleotides are the reverse complement of two tandem stop codons, and $(N)_{15}$ is identical to the reverse complement of the last 15 nucleotides encoding the Therapeutic protein of interest. Once the PCR product is amplified it may be cut with Bsu36I and one of (Asc I, Fse I, or Pme I) and ligated into pScNHSA.

The presence of the Xho I site in the HSA chimeric leader sequence creates a single amino acid change in the end of the chimeric signal sequence, i.e. the HSA-kex2 signal sequence, from LDKR (SEQ ID NO:44) to LEKR (SEQ ID NO:45).

Generation of Albumin Fusion Constructs Comprising Gene-HSA Fusion Products.

Similar to the method described above, DNA encoding a Therapeutic protein may be PCR amplified using the following primers: A 5' primer that adds polynucleotides containing a SalI site and encoding the last three amino acids of the HSA leader sequence, DKR, onto the 5' end of DNA encoding a Therapeutic protein; and a 3' primer that adds polynucleotides encoding the first few amino acids of the mature HSA containing a Cla I site onto the 3' end of DNA encoding a Therapeutic protein. For instance, the forward primer used to amplify the DNA encoding a Therapeutic protein might have the sequence, 5'-aggagcgtcGACAAAAGA$(N)_{15}$-3' (SEQ ID NO:46) where the underlined sequence is a Sal I site, the upper case nucleotides encode the last three amino acids of the HSA leader sequence (DKR), and $(N)_{15}$ is identical to the first 15 nucleotides encoding the Therapeutic protein of interest. Similarly, the reverse primer used to amplify the DNA encoding a Therapeutic protein might have the sequence, 5'-CTTTAAATCG ATGAGCAACCTCACTCTTGTGTGCATC$(N)_{15}$-3' (SEQ ID NO:47) where the italicized sequence is a Cla I site, the underlined nucleotides are the reverse complement of the DNA encoding the first 9 amino acids of the mature form of HSA (DAHKSEVAH, SEQ ID NO:48), and $(N)_{15}$ is identical to the reverse complement of the last 15 nucleotides encoding the Therapeutic protein of interest. Once the PCR product is amplified it may be cut with Sal I and Cla I and ligated into pScCHSA digested with Xho I and Cla I. A different signal or leader sequence may be desired, for example, invertase "INV" (Swiss-Prot Accession P00724), mating factor alpha "MAF" (Genbank Accession AAA18405), MPIF (Geneseq AAF82936), Fibulin B (Swiss-Prot Accession P23142), Clusterin (Swiss-Prot Accession P10909), Insulin-Like Growth Factor—Binding Protein 4 (Swiss-Prot Accession P22692), and permutations of the HSA leader sequence can be subcloned into the appropriate vector by means of standard methods known in the art.

Generation of Albumin Fusion Construct Compatible for Expression in Yeast *S. cerevisiae*.

The Not I fragment containing the DNA encoding either an N-terminal or C-terminal albumin fusion protein generated from pScNHSA or pScCHSA may then be cloned into the Not I site of pSAC35 which has a LEU2 selectable marker. The resulting vector is then used in transformation of a yeast *S. cerevisiae* expression system.

Example 3

General Expression in Yeast *S. cerevisiae*

Figure 3:
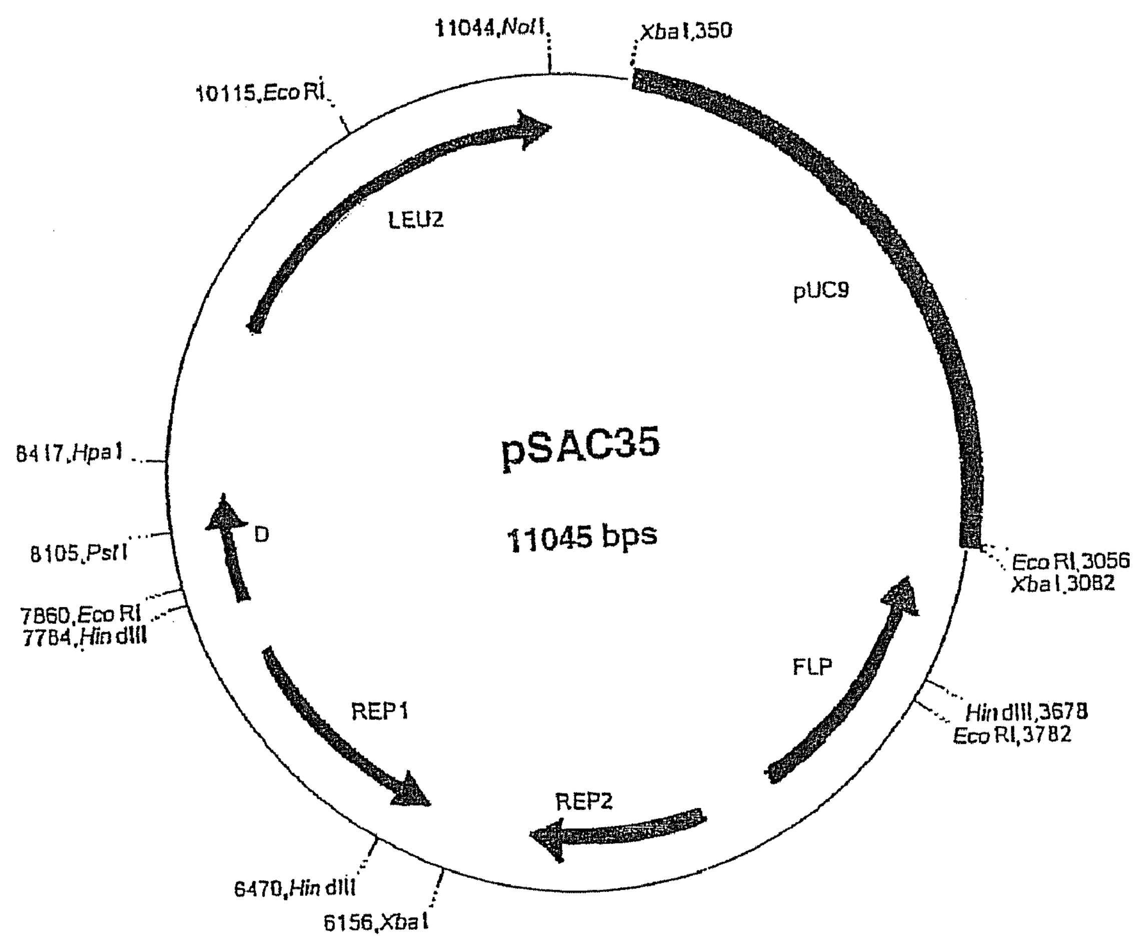
FIG. 3 shows the restriction map of the pSAC35 yeast *S. cerevisiae* expression vector (Sleep et al., BioTechnology 8:42 (1990)).

An expression vector compatible with yeast expression can be transformed into yeast *S. cerevisiae* by lithium acetate transformation, electroporation, or other methods known in the art and or as described in part in Sambrook, Fritsch, and Maniatis. 1989. "Molecular Cloning: A Laboratory Manual, 2nd edition", volumes 1-3, and in Ausubel et al. 2000. Massachusetts General Hospital and Harvard Medical School "Current Protocols in Molecular Biology", volumes 1-4. The expression vectors are introduced into *S. cerevisiae* strains DXY1, D88, or BXP10 by transformation, individual transformants can be grown, for example, for 3 days at 30° C. in 10 mL YEPD (1% w/v yeast extract, 2% w/v, peptone, 2% w/v, dextrose), and cells can be collected at stationary phase after 60 hours of growth. Supernatants are collected by clarifying cells at 3000 g for 10 minutes.

pSAC35 (Sleep et al., 1990, Biotechnology 8:42 and see FIG. 3) comprises, in addition to the LEU2 selectable marker, the entire yeast 2 μm plasmid to provide replication functions, the PRB1 promoter, and the ADH1 termination signal.

Example 4

General Purification of an Albumin Fusion Protein Expressed from an Albumin Fusion in Yeast *S. cerevisiae*

In preferred embodiments, albumin fusion proteins of the invention comprise the mature form of HSA fused to either the N- or C-terminus of the mature form of a therapeutic protein or portions thereof (e.g., the mature form of a therapeutic protein listed in Table 1, or the mature form of a therapeutic protein shown in Table 2 as SEQ ID NO:Z). In one embodiment of the invention, albumin fusion proteins of the invention further comprise a signal sequence which directs the nascent fusion polypeptide in the secretory pathways of the host used for expression. In a preferred embodiment, the signal peptide encoded by the signal sequence is removed, and the mature albumin fusion protein is secreted directly into the culture medium. Albumin fusion proteins of the invention preferably comprise heterologous signal sequences (e.g., the non-native signal sequence of a particular therapeutic protein) including, but not limited to, MAF, INV, Ig, Fibulin B, Clusterin, Insulin-Like Growth Factor Binding Protein 4, variant HSA leader sequences including, but not limited to, a chimeric HSA/MAF leader sequence, or other heterologous signal sequences known in the art. Especially preferred as those signal sequence listed in Table 2 and/or the signal sequence listed in the "Expression of Fusion Proteins" and/or "Additional Methods of Recombinant and Synthetic Production of Albumin Fusion Proteins" section of the specification, above. In preferred embodiments, the fusion proteins of the invention further comprise an N-terminal methionine residue. Polynucleotides encoding these polypeptides, including fragments and/or variants, are also encompassed by the invention.

Albumin fusion proteins expressed in yeast as described above can be purified on a small-scale over a Dyax peptide affinity column as follows. Supernatants from yeast expressing an albumin fusion protein is diafiltrated against 3 mM phosphate buffer pH 6.2, 20 mM NaCl and 0.01% Tween 20 to reduce the volume and to remove the pigments. The solution is then filtered through a 0.22 μm device. The filtrate is loaded onto a Dyax peptide affinity column. The column is eluted with 100 mM Tris/HCl, pH 8.2 buffer. The peak fractions containing protein are collected and analyzed on SDS-PAGE after concentrating 5-fold.

For large scale purification, the following method can be utilized. The supernatant in excess of 2 L is diafiltered and concentrated to 500 mL in 20 mM Tris/HCl pH 8.0. The concentrated protein solution is loaded onto a pre-equilibrated 50 mL DEAE-Sepharose Fast Flow column, the column is washed, and the protein is eluted with a linear gradient of NaCl from 0 to 0.4 M NaCl in 20 mM Tris/HCl, pH 8.0. Those fractions containing the protein are pooled, adjusted to pH 6.8 with 0.5 M sodium phosphate ($NaH_2PO_4$). A final concentration of 0.9 M $(NH_4)_2SO_4$ is added to the protein solution and the whole solution is loaded onto a pre-equilibrated 50 mL Butyl650S column. The protein is eluted with a linear gradient of ammonium sulfate (0.9 to 0 M $(NH_4)_2SO_4$). Those fractions with the albumin fusion are again pooled, diafiltered against 10 mM $Na_2HPO_4$/citric acid buffer pH 5.75, and loaded onto a 50 mL pre-equilibrated SP-Sepharose Fast Flow column. The protein is eluted with a NaCl linear gradient from 0 to 0.5 M. The fractions containing the protein of interest are combined, the buffer is changed to 10 mM $Na_2HPO_4$/citric acid pH 6.25 with an Amicon concentrator, the conductivity is <2.5 mS/cm. This protein solution is loaded onto a 15 mL pre-equilibrated Q-Sepharose high performance column, the column is washed, and the protein is eluted with a NaCl linear gradient from 0 to 0.15 M NaCl. The purified protein can then be formulated into a specific buffer composition by buffer exchange.

Example 5

General Construct Generation for Mammalian Cell Transfection

Generation of Albumin Fusion Construct Compatible for Expression in Mammalian Cell-Lines.

Albumin fusion constructs can be generated in expression vectors for use in mammalian cell culture systems. DNA encoding a therapeutic protein can be cloned N-terminus or C-terminus to HSA in a mammalian expression vector by standard methods known in the art (e.g., PCR amplification, restriction digestion, and ligation). Once the expression vector has been constructed, transfection into a mammalian expression system can proceed. Suitable vectors are known in the art including, but not limited to, for example, the pC4 vector, and/or vectors available from Lonza Biologics, Inc. (Portsmouth, N.H.).

The DNA encoding human serum albumin has been cloned into the pC4 vector which is suitable for mammalian culture systems, creating plasmid pC4:HSA (ATCC™ Deposit #PTA-3277). This vector has a DiHydroFolate Reductase, "DHFR", gene that will allow for selection in the presence of methotrexate.

The pC4:HSA vector is suitable for expression of albumin fusion proteins in CHO cells. For expression, in other mammalian cell culture systems, it may be desirable to subclone a fragment comprising, or alternatively consisting of, DNA which encodes for an albumin fusion protein into an alternative expression vector. For example, a fragment comprising, or alternatively consisting, of DNA which encodes for a mature albumin fusion protein may be subcloned into another expression vector including, but not limited to, any of the mammalian expression vectors described herein.

In a preferred embodiment, DNA encoding an albumin fusion construct is subcloned into vectors provided by Lonza Biologics, Inc. (Portsmouth, N.H.) by procedures known in the art for expression in NS0 cells.

Generation of Albumin Fusion Constructs Comprising HSA-Therapeutic Protein Fusion Products.

Using pC4:HSA (ATCC™ Deposit #PTA-3277), albumin fusion constructs can be generated in which the Therapeutic protein portion is C terminal to the mature albumin sequence. For example, one can clone DNA encoding a Therapeutic protein of fragment or variant thereof between the Bsu 361 and Asc I restriction sites of the vector. When cloning into the Bsu 361 and Asc I, the same primer design used to clone into the yeast vector system (SEQ ID NO:42 and 43) may be employed (see Example 2).

Generation of Albumin Fusion Constructs Comprising Gene-HSA Fusion Products.

Using pC4:HSA (ATCC™ Deposit #PTA-3277), albumin fusion constructs can be generated in which a Therapeutic protein portion is cloned N terminal to the mature albumin sequence. For example, one can clone DNA encoding a Therapeutic protein that has its own signal sequence between the Bam HI (or Hind III) and Cla I sites of pC4:HSA. When cloning into either the Bam HI or Hind III site, it is preferable to include a Kozak sequence (CCGCCACCATG, SEQ ID NO:49) prior to the translational start codon of the DNA encoding the Therapeutic protein. If a Therapeutic protein does not have a signal sequence, DNA encoding that Therapeutic protein may be cloned in between the Xho I and Cla I sites of pC4:HSA. When using the Xho I site, the following 5' (SEQ ID NO:50) and 3' (SEQ ID NO:51) exemplary PCR primers may be used:

5'-CCGCCG CTCGAGGGGTGTGTTTCGTCGA$(N)_{18}$-3' (SEQ ID NO: 50)

5'-AGTCCC ATCGATGAGCAACCTCACTCTTGTGTGCATC$(N)_{18}$-3' (SEQ ID NO:51)

In the 5' primer (SEQ ID NO:50), the underlined sequence is a Xho I site; and the Xho I site and the DNA following the Xho I site code for the last seven amino acids of the leader sequence of natural human serum albumin. In SEQ ID NO:50, "$(N)_{18}$" is DNA identical to the first 18 nucleotides encoding the Therapeutic protein of interest. In the 3' primer (SEQ ID NO:51), the underlined sequence is a Cla I site; and the Cla I site and the DNA following it are the reverse complement of the DNA encoding the first 10 amino acids of the mature HSA protein (SEQ ID NO:1). In SEQ ID NO:51 "$(N)_{18}$" is the reverse complement of DNA encoding the last 18 nucleotides encoding the Therapeutic protein of interest. Using these two primers, one may PCR amplify the Therapeutic protein of interest, purify the PCR product, digest it with Xho I and Cla I restriction enzymes and clone it into the Xho I and Cla I sites in the pC4:HSA vector.

If an alternative leader sequence is desired, the native albumin leader sequence can be replaced with the chimeric albumin leader, i.e., the HSA-kex2 signal peptide, or an alternative leader by standard methods known in the art. (For example, one skilled in the art could routinely PCR amplify an alternate leader and subclone the PCR product into an albumin fusion construct in place of the albumin leader while maintaining the reading frame).

Example 6

General Expression in Mammalian Cell-Lines

An albumin fusion construct generated in an expression vector compatible with expression in mammalian cell-lines can be transfected into appropriate cell-lines by calcium phosphate precipitation, lipofectamine, electroporation, or other transfection methods known in the art and/or as described in Sambrook, Fritsch, and Maniatis. 1989. "Molecular Cloning: A Laboratory Manual, 2$^{nd}$ edition" and in Ausubel et al. 2000. Massachusetts General Hospital and Harvard Medical School "Current Protocols in Molecular Biology", volumes 1-4. The transfected cells are then selected for by the presence of a selecting agent determined by the selectable marker in the expression vector.

The pC4 expression vector (ATCC™ Accession No. 209646) is a derivative of the plasmid pSV2-DHFR (ATCC™ Accession No. 37146). pC4 contains the strong promoter Long Terminal Repeats "LTR" of the Rous Sarcoma Virus (Cullen et al., March 1985, Molecular and Cellular Biology, 438-447) and a fragment of the CytoMegaloVirus "CMV"-enhancer (Boshart et al., 1985, Cell 41: 521-530). The vector also contains the 3' intron, the polyadenylation and termination signal of the rat preproinsulin gene, and the mouse DHFR gene under control of the SV40 early promoter. Chinese hamster ovary "CHO" cells or other cell-lines lacking an active DHFR gene are used for transfection. Transfection of an albumin fusion construct in pC4 into CHO cells by methods known in the art will allow for the expression of the albumin fusion protein in CHO cells, followed by leader sequence cleavage, and secretion into the supernatant. The albumin fusion protein is then further purified from the supernatant.

The pEE12.1 expression vector is provided by Lonza Biologics, Inc. (Portsmouth, N.H.) and is a derivative of pEE6 (Stephens and Cockett, 1989, Nucl. Acids Res. 17: 7110). This vector comprises a promoter, enhancer and complete 5'-untranslated region of the Major Immediate Early gene of the human CytoMegaloVirus, "hCMV-MIE" (International Publication #WO89/01036), upstream of a sequence of interest, and a Glutamine Synthetase gene (Murphy et al., 1991, Biochem J. 227: 277-279; Bebbington et al., 1992, Bio/Technology 10:169-175; U.S. Pat. No. 5,122,464) for purposes of selection of transfected cells in selective methionine sulphoximine containing medium. Transfection of albumin fusion constructs made in pEE12.1 into NS0 cells (International Publication #WO86/05807) by methods known in the art will allow for the expression of the albumin fusion protein in NS0 cells, followed by leader sequence cleavage, and secretion into the supernatant. The albumin fusion protein is then further purified from the supernatant using techniques described herein or otherwise known in the art.

Expression of an albumin fusion protein may be analyzed, for example, by SDS-PAGE and Western blot, reversed phase HPLC analysis, or other methods known in the art.

Stable CHO and NS0 cell-lines transfected with albumin fusion constructs are generated by methods known in the art (e.g., lipofectamine transfection) and selected, for example, with 100 nM methotrexate for vectors having the DiHydro-Folate Reductase 'DHFR' gene as a selectable marker or through growth in the absence of glutamine. Expression levels can be examined for example, by immunoblotting, primarily, with an anti-HSA serum as the primary antibody, or, secondarily, with serum containing antibodies directed to the Therapeutic protein portion of a given albumin fusion protein as the primary antibody.

Expression levels are examined by immunoblot detection with anti-HSA serum as the primary antibody. The specific productivity rates are determined via ELISA in which the capture antibody can be a monoclonal antibody towards the therapeutic protein portion of the albumin fusion and the detecting antibody can be the monoclonal anti-HSA-biotinylated antibody (or vice versa), followed by horseradish peroxidase/streptavidin binding and analysis according to the manufacturer's protocol.

Example 7

Expression of an Albumin Fusion Protein in Mammalian Cells

The albumin fusion proteins of the present invention can be expressed in a mammalian cell. A typical mammalian expression vector contains a promoter element, which mediates the initiation of transcription of mRNA, a protein coding sequence, and signals required for the termination of transcription and polyadenylation of the transcript. Additional elements include enhancers, Kozak sequences and intervening sequences flanked by donor and acceptor sites for RNA splicing. Highly efficient transcription is achieved with the early and late promoters from SV40, the long terminal repeats (LTRs) from Retroviruses, e.g., RSV, HTLVI, HIVI and the early promoter of the cytomegalovirus (CMV). However, cellular elements can also be used (e.g., the human actin promoter).

Suitable expression vectors for use in practicing the present invention include, for example, vectors such as, pSVL and pMSG (Pharmacia, Uppsala, Sweden), pRSVcat (ATCC™ 37152), pSV2dhfr (ATCC™ 37146), pBC12MI (ATCC™ 67109), pCMVSport 2.0, and pCMVSport 3.0. Mammalian host cells that could be used include, but are not limited to, human Hela, 293, H9 and Jurkat cells, mouse NIH3T3 and C127 cells, Cos 1, Cos 7 and CV1, quail QC1-3 cells, mouse L cells and Chinese hamster ovary (CHO) cells.

Alternatively, the albumin fusion protein can be expressed in stable cell lines containing the polynucleotide encoding the albumin fusion protein integrated into a chromosome. The co-transfection with a selectable marker such as DHFR, gpt, neomycin, or hygromycin allows the identification and isolation of the transfected cells.

The transfected polynucleotide encoding the fusion protein can also be amplified to express large amounts of the encoded fusion protein. The DHFR (dihydrofolate reductase) marker is useful in developing cell lines that carry several hundred or even several thousand copies of the gene of interest. (See, e.g., Alt et al., J. Biol. Chem. 253:1357-1370 (1978); Hamlin et al., Biochem. et Biophys. Acta, 1097:107-143 (1990); Page et al., Biotechnology 9:64-68 (1991)). Another useful selection marker is the enzyme glutamine synthase (GS) (Murphy et al., Biochem J. 227:277-279 (1991); Bebbington et al., Bio/Technology 10:169-175 (1992). Using these markers, the mammalian cells are grown in selective medium and the cells with the highest resistance are selected. These cell lines contain the amplified gene(s) integrated into a chromosome. Chinese hamster ovary (CHO) and NS0 cells are often used for the production of proteins.

Derivatives of the plasmid pSV2-dhfr (ATCC™ Accession No. 37146), the expression vectors pC4 (ATCC™ Accession No. 209646) and pC6 (ATCC™ Accession No. 209647) contain the strong promoter (LTR) of the Rous Sarcoma Virus (Cullen et al., Molecular and Cellular Biology, 438-447 (March, 1985)) plus a fragment of the CMV-enhancer (Boshart et al., Cell 41:521-530 (1985)). Multiple cloning sites, e.g., with the restriction enzyme cleavage sites BamHI, XbaI and Asp718, facilitate the cloning of the gene of interest. The vectors also contain the 3' intron, the polyadenylation and termination signal of the rat preproinsulin gene, and the mouse DHFR gene under control of the SV40 early promoter.

Specifically, the plasmid pC6, for example, is digested with appropriate restriction enzymes and then dephosphorylated using calf intestinal phosphates by procedures known in the art. The vector is then isolated from a 1% agarose gel.

A polynucleotide encoding an albumin fusion protein of the present invention is generated using techniques known in the art and this polynucleotide is amplified using PCR technology known in the art. If a naturally occurring signal sequence is used to produce the fusion protein of the present invention, the vector does not need a second signal peptide. Alternatively, if a naturally occurring signal sequence is not used, the vector can be modified to include a heterologous signal sequence. (See, e.g., International Publication No. WO 96/34891.)

The amplified fragment encoding the fusion protein of the invention is isolated from a 1% agarose gel using a commercially available kit ("Geneclean," BIO 101 Inc., La Jolla, Calif.). The fragment then is digested with appropriate restriction enzymes and again purified on a 1% agarose gel.

The amplified fragment encoding the albumin fusion protein of the invention is then digested with the same restriction enzyme and purified on a 1% agarose gel. The isolated fragment and the dephosphorylated vector are then ligated with T4 DNA ligase. *E. coli* HB101 or XL-1 Blue cells are then transformed and bacteria are identified that contain the fragment inserted into plasmid pC6 using, for instance, restriction enzyme analysis.

Chinese hamster ovary cells lacking an active DHFR gene is used for transfection. Five μg of the expression plasmid pC6 or pC4 is cotransfected with 0.5 μg of the plasmid pSV-neo using lipofectin (Felgner et al., supra). The plasmid pSV2-neo contains a dominant selectable marker, the neo gene from Tn5 encoding an enzyme that confers resistance to a group of antibiotics including G418. The cells are seeded in alpha minus MEM supplemented with 1 mg/ml G418. After 2 days, the cells are trypsinized and seeded in hybridoma cloning plates (Greiner, Germany) in alpha minus MEM supplemented with 10, 25, or 50 ng/ml of methotrexate plus 1 mg/ml G418. After about 10-14 days single clones are trypsinized and then seeded in 6-well petri dishes or 10 ml flasks using different concentrations of methotrexate (50 nM, 100 nM, 200 nM, 400 nM, 800 nM). Clones growing at the highest concentrations of methotrexate are then transferred to new 6-well plates containing even higher concentrations of methotrexate (1 μM, 2 μM, 5 μM, 10 mM, 20 mM). The same procedure is repeated until clones are obtained which grow at a concentration of 100-200 μM. Expression of the desired fusion protein is analyzed, for instance, by SDS-PAGE and Western blot or by reversed phase HPLC analysis.

Example 8

General Purification of an Albumin Fusion Protein Expressed from an Albumin Fusion Construct in Mammalian Cell-Lines In preferred embodiments, albumin fusion proteins of the invention comprise the mature form of HSA fused to either the N- or C-terminus of the mature form of a therapeutic protein or portions thereof (e.g., the mature form of a therapeutic protein listed in Table 1, or the mature form of a therapeutic protein shown in Table 2 as SEQ ID NO:Z). In one embodiment of the invention, albumin fusion proteins of the invention further comprise a signal sequence which directs the nascent fusion polypeptide in the secretory pathways of the host used for expression. In a preferred embodiment, the signal peptide encoded by the signal sequence is removed, and the mature albumin fusion protein is secreted directly into the culture medium. Albumin fusion proteins of the invention preferably comprise heterologous signal sequences (e.g., the non-native signal sequence of a particular therapeutic protein) including, but not limited to, MAF, INV, Ig, Fibulin B, Clusterin, Insulin-Like Growth Factor Binding Protein 4, variant HSA leader sequences including, but not limited to, a chimeric HSA/MAF leader sequence, or other heterologous signal sequences known in the art. Especially preferred as those signal sequence listed in Table 2 and/or the signal sequence listed in the "Expression of Fusion Proteins" and/or "Additional Methods of Recombinant and Synthetic Production of Albumin Fusion Proteins" section of the specification, above. In preferred embodiments, the fusion proteins of the invention further comprise an N-terminal methionine residue. Polynucleotides encoding these polypeptides, including fragments and/or variants, are also encompassed by the invention.

Albumin fusion proteins from mammalian cell-line supernatants are purified according to different protocols depending on the expression system used.

Purification from CHO and 293T Cell-Lines.

Purification of an albumin fusion protein from CHO cell supernatant or from transiently transfected 293T cell supernatant may involve initial capture with an anionic HQ resin using a sodium phosphate buffer and a phosphate gradient elution, followed by affinity chromatography on a Blue Sepharose FF column using a salt gradient elution. Blue Sepharose FF removes the main BSA/fetuin contaminants. Further purification over the Poros PI 50 resin with a phosphate gradient may remove and lower endotoxin contamination as well as concentrate the albumin fusion protein.

Purification from NS0 Cell-Line.

Purification of an albumin-fusion protein from NS0 cell supernatant may involve Q-Sepharose anion exchange chromatography, followed by SP-sepharose purification with a step elution, followed by Phenyl-650M purification with a step elution, and, ultimately, diafiltration.

The purified protein may then be formulated by buffer exchange.

Example 9

Bacterial Expression of an Albumin Fusion Protein

A polynucleotide encoding an albumin fusion protein of the present invention comprising a bacterial signal sequence is amplified using PCR oligonucleotide primers corresponding to the 5' and 3' ends of the DNA sequence, to synthesize insertion fragments. The primers used to amplify the polynucleotide encoding insert should preferably contain restriction sites, such as BamHI and XbaI, at the 5' end of the primers in order to clone the amplified product into the expression vector. For example, BamHI and XbaI correspond to the restriction enzyme sites on the bacterial expression vector pQE-9. (Qiagen, Inc., Chatsworth, Calif.). This plasmid vector encodes antibiotic resistance ($Amp^r$), a bacterial origin of replication (ori), an IPTG-regulatable promoter/operator (P/O), a ribosome binding site (RBS), a 6-histidine tag (6-His), and restriction enzyme cloning sites.

The pQE-9 vector is digested with BamHI and XbaI and the amplified fragment is ligated into the pQE-9 vector maintaining the reading frame initiated at the bacterial RBS. The ligation mixture is then used to transform the *E. coli* strain M15/rep4 (Qiagen, Inc.) which contains multiple copies of the plasmid pREP4, which expresses the lacI repressor and also confers kanamycin resistance ($Kan^r$). Transformants are identified by their ability to grow on LB plates and ampicillin/kanamycin resistant colonies are selected. Plasmid DNA is isolated and confirmed by restriction analysis.

Clones containing the desired constructs are grown overnight (O/N) in liquid culture in LB media supplemented with both Amp (100 ug/ml) and Kan (25 ug/ml). The O/N culture is used to inoculate a large culture at a ratio of 1:100 to 1:250. The cells are grown to an optical density 600 ($O.D.^{600}$) of between 0.4 and 0.6. IPTG (Isopropyl-B-D-thiogalacto pyranoside) is then added to a final concentration of 1 mM. IPTG induces by inactivating the lacI repressor, clearing the P/0 leading to increased gene expression.

Cells are grown for an extra 3 to 4 hours. Cells are then harvested by centrifugation (20 mins at 6000×g). The cell pellet is solubilized in the chaotropic agent 6 Molar Guanidine HCl or preferably in 8 M urea and concentrations greater than 0.14 M 2-mercaptoethanol by stirring for 3-4 hours at 4° C. (see, e.g., Burton et al., Eur. J. Biochem. 179:379-387

(1989)). The cell debris is removed by centrifugation, and the supernatant containing the polypeptide is loaded onto a nickel-nitrilo-tri-acetic acid ("Ni-NTA") affinity resin column (available from QIAGEN, Inc., supra). Proteins with a 6×His tag bind to the Ni-NTA resin with high affinity and can be purified in a simple one-step procedure (for details see: The QIAexpressionist (1995) QIAGEN, Inc., supra).

Briefly, the supernatant is loaded onto the column in 6 M guanidine-HCl, pH 8. The column is first washed with 10 volumes of 6 M guanidine-HCl, pH 8, then washed with 10 volumes of 6 M guanidine-HCl pH 6, and finally the polypeptide is eluted with 6 M guanidine-HCl, pH 5.

The purified protein is then renatured by dialyzing it against phosphate-buffered saline (PBS) or 50 mM Na-acetate, pH 6 buffer plus 200 mM NaCl. Alternatively, the protein can be successfully refolded while immobilized on the Ni-NTA column. Exemplary conditions are as follows: renature using a linear 6M-1M urea gradient in 500 mM NaCl, 20% glycerol, 20 mM Tris/HCl pH 7.4, containing protease inhibitors. The renaturation should be performed over a period of 1.5 hours or more. After renaturation the proteins are eluted by the addition of 250 mM immidazole. Immidazole is removed by a final dialyzing step against PBS or 50 mM sodium acetate pH 6 buffer plus 200 mM NaCl. The purified protein is stored at 4° C. or frozen at −80° C.

In addition to the above expression vector, the present invention further includes an expression vector, called pHE4a (ATCC™ Accession Number 209645, deposited on Feb. 25, 1998) which contains phage operator and promoter elements operatively linked to a polynucleotide encoding an albumin fusion protein of the present invention, called pHE4a. (ATCC™ Accession Number 209645, deposited on Feb. 25, 1998.) This vector contains: 1) a neomycinphosphotransferase gene as a selection marker, 2) an *E. coli* origin of replication, 3) a T5 phage promoter sequence, 4) two lac operator sequences, 5) a Shine-Delgarno sequence, and 6) the lactose operon repressor gene (lacIq). The origin of replication (oriC) is derived from pUC19 (LTI, Gaithersburg, Md.). The promoter and operator sequences are made synthetically.

DNA can be inserted into the pHE4a by restricting the vector with NdeI and XbaI, BamHI, XhoI, or Asp718, running the restricted product on a gel, and isolating the larger fragment (the stuffer fragment should be about 310 base pairs). The DNA insert is generated according to PCR protocols described herein or otherwise known in the art, using PCR primers having restriction sites for NdeI (5' primer) and XbaI, BamHI, XhoI, or Asp718 (3' primer). The PCR insert is gel purified and restricted with compatible enzymes. The insert and vector are ligated according to standard protocols.

The engineered vector may be substituted in the above protocol to express protein in a bacterial system.

Example 10

Isolation of a Selected cDNA Clone from the Deposited Sample

Many of the albumin fusion constructs of the invention have been deposited with the ATCC™ as shown in Table 3. The albumin fusion constructs may comprise any one of the following expression vectors: the yeast *S. cerevisiae* expression vector pSAC35, the mammalian expression vector pC4, or the mammalian expression vector pEE12.1.

pSAC35 (Sleep et al., 1990, Biotechnology 8:42), pC4 (ATCC™ Accession No. 209646; Cullen et al., Molecular and Cellular Biology, 438-447 (1985); Boshart et al., Cell 41: 521-530 (1985)), and pEE12.1 (Lonza Biologics, Inc.; Stephens and Cockett, Nucl. Acids Res. 17: 7110 (1989); International Publication #WO89/01036; Murphy et al., Biochem J. 227: 277-279 (1991); Bebbington et al., Bio/Technology 10:169-175 (1992); U.S. Pat. No. 5,122,464; International Publication #WO86/05807) vectors comprise an ampicillin resistance gene for growth in bacterial cells. These vectors and/or an albumin fusion construct comprising them can be transformed into an *E. coli* strain such as Stratagene XL-1 Blue (Stratagene Cloning Systems, Inc., 11011 N. Torrey Pines Road, La Jolla, Calif., 92037) using techniques described in the art such as Hanahan, spread onto Luria-Broth agar plates containing 100 g/mL ampicillin, and grown overnight at 37° C.

The deposited material in the sample assigned the ATCC™ Deposit Number cited in Table 3 for any given albumin fusion construct also may contain one or more additional albumin fusion constructs, each encoding different albumin fusion proteins. Thus, deposits sharing the same ATCC™ Deposit Number contain at least an albumin fusion construct identified in the corresponding row of Table 3.

Two approaches can be used to isolate a particular albumin fusion construct from the deposited sample of plasmid DNAs cited for that albumin fusion construct in Table 3.

Method 1: Screening

First, an albumin fusion construct may be directly isolated by screening the sample of deposited plasmid DNAs using a polynucleotide probe corresponding to SEQ ID NO:X for an individual construct ID number in Table 1, using methods known in the art. For example, a specific polynucleotide with 30-40 nucleotides may be synthesized using an Applied Biosystems DNA synthesizer according to the sequence reported. The oligonucleotide can be labeled, for instance, with $^{32}$P-γ-ATP using T4 polynucleotide kinase and purified according to routine methods. (E.g., Maniatis et al., Molecular Cloning: A Laboratory Manual, Cold Spring Harbor Press, Cold Spring, N.Y. (1982)). The albumin fusion construct from a given ATCC™ deposit is transformed into a suitable host, as indicated above (such as XL-1 Blue (Stratagene)) using techniques known to those of skill in the art, such as those provided by the vector supplier or in related publications or patents cited above. The transformants are plated on 1.5% agar plates (containing the appropriate selection agent, e.g., ampicillin) to a density of about 150 transformants (colonies) per plate. These plates are screened using Nylon membranes according to routine methods for bacterial colony screening (e.g., Sambrook et al., Molecular Cloning: A Laboratory Manual, 2nd Edit., (1989), Cold Spring Harbor Laboratory Press, pages 1.93 to 1.104), or other techniques known to those of skill in the art.

Method 2: PCR

Alternatively, DNA encoding a given albumin fusion protein may be amplified from a sample of a deposited albumin fusion construct with SEQ ID NO:X, for example, by using two primers of 17-20 nucleotides that hybridize to the deposited albumin fusion construct 5' and 3' to the DNA encoding a given albumin fusion protein. The polymerase chain reaction is carried out under routine conditions, for instance, in 25 μl of reaction mixture with 0.5 ug of the above cDNA template. A convenient reaction mixture is 1.5-5 mM $MgCl_2$, 0.01% (w/v) gelatin, 20 μM each of dATP, dCTP, dGTP, dTTP, 25 pmol of each primer and 0.25 Unit of Taq polymerase. Thirty five cycles of PCR (denaturation at 94° C. for 1 min; annealing at 55° C. for 1 min; elongation at 72° C. for 1 min) are performed with a Perkin-Elmer Cetus automated thermal cycler. The amplified product is analyzed by agarose gel electrophoresis and the DNA band with expected molecular weight is excised and purified. The PCR product is verified to be the selected sequence by subcloning and sequencing the DNA product.

Several methods are available for the identification of the 5' or 3' non-coding portions of a gene which may not be present in the deposited clone. These methods include but are not limited to, filter probing, clone enrichment using specific probes, and protocols similar or identical to 5' and 3' "RACE" protocols which are known in the art. For instance, a method similar to 5' RACE is available for generating the missing 5' end of a desired full-length transcript. (Fromont-Racine et al., Nucleic Acids Res., 21(7):1683-1684 (1993)).

Briefly, a specific RNA oligonucleotide is ligated to the 5' ends of a population of RNA presumably containing full-length gene RNA transcripts. A primer set containing a primer specific to the ligated RNA oligonucleotide and a primer specific to a known sequence of the gene of interest is used to PCR amplify the 5' portion of the desired full-length gene. This amplified product may then be sequenced and used to generate the full length gene.

This above method starts with total RNA isolated from the desired source, although poly-A+ RNA can be used. The RNA preparation can then be treated with phosphatase if necessary to eliminate 5' phosphate groups on degraded or damaged RNA which may interfere with the later RNA ligase step. The phosphatase should then be inactivated and the RNA treated with tobacco acid pyrophosphatase in order to remove the cap structure present at the 5' ends of messenger RNAs. This reaction leaves a 5' phosphate group at the 5' end of the cap cleaved RNA which can then be ligated to an RNA oligonucleotide using T4 RNA ligase.

This modified RNA preparation is used as a template for first strand cDNA synthesis using a gene specific oligonucleotide. The first strand synthesis reaction is used as a template for PCR amplification of the desired 5' end using a primer specific to the ligated RNA oligonucleotide and a primer specific to the known sequence of the gene of interest. The resultant product is then sequenced and analyzed to confirm that the 5' end sequence belongs to the desired gene.

Example 11

Multifusion Fusions

The albumin fusion proteins (e.g., containing a Therapeutic protein (or fragment or variant thereof) fused to albumin (or a fragment or variant thereof)) may additionally be fused to other proteins to generate "multifusion proteins". These multifusion proteins can be used for a variety of applications. For example, fusion of the albumin fusion proteins of the invention to His-tag, HA-tag, protein A, IgG domains, and maltose binding protein facilitates purification. (See e.g., EP A 394,827; Traunecker et al., Nature 331:84-86 (1988)). Nuclear localization signals fused to the polypeptides of the present invention can target the protein to a specific subcellular localization, while covalent heterodimer or homodimers can increase or decrease the activity of an albumin fusion protein. Furthermore, the fusion of additional protein sequences to the albumin fusion proteins of the invention may further increase the solubility and/or stability of the fusion protein. The fusion proteins described above can be made using or routinely modifying techniques known in the art and/or by modifying the following protocol, which outlines the fusion of a polypeptide to an IgG molecule.

Briefly, the human Fc portion of the IgG molecule can be PCR amplified, using primers that span the 5' and 3' ends of the sequence described below. These primers also should have convenient restriction enzyme sites that will facilitate cloning into an expression vector, preferably a mammalian or yeast expression vector.

For example, if pC4 (ATCC™ Accession No. 209646) is used, the human Fc portion can be ligated into the BamHI cloning site. Note that the 3' BamHI site should be destroyed. Next, the vector containing the human Fc portion is re-restricted with BamHI, linearizing the vector, and a polynucleotide encoding an albumin fusion protein of the present invention (generated and isolated using techniques known in the art), is ligated into this BamHI site. Note that the polynucleotide encoding the fusion protein of the invention is cloned without a stop codon, otherwise a Fc containing fusion protein will not be produced.

If the naturally occurring signal sequence is used to produce the albumin fusion protein of the present invention, pC4 does not need a second signal peptide. Alternatively, if the naturally occurring signal sequence is not used, the vector can be modified to include a heterologous signal sequence. (See, e.g., International Publication No. WO 96/34891.)

Human IgG Fc Region:

```
                                          (SEQ ID NO: 52)
GGGATCCGGAGCCCAAATCTTCTGACAAAACTCACACATGCCCACCGTGC

CCAGCACCTGAATTCGAGGGTGCACCGTCAGTCTTCCTCTTCCCCCCAAA

ACCCAAGGACACCCTCATGATCTCCCGGACTCCTGAGGTCACATGCGTGG

TGGTGGACGTAAGCCACGAAGACCCTGAGGTCAAGTTCAACTGGTACGTG

GACGGCGTGGAGGTGCATAATGCCAAGACAAAGCCGCGGGAGGAGCAGTA

CAACAGCACGTACCGTGTGGTCAGCGTCCTCACCGTCCTGCACCAGGACT

GGCTGAATGGCAAGGAGTACAAGTGCAAGGTCTCCAACAAAGCCCTCCCA

ACCCCCATCGAGAAAACCATCTCCAAAGCCAAAGGGCAGCCCCGAGAACC

ACAGGTGTACACCCTGCCCCCATCCCGGGATGAGCTGACCAAGAACCAGG

TCAGCCTGACCTGCCTGGTCAAAGGCTTCTATCCAAGCGACATCGCCGTG

GAGTGGGAGAGCAATGGGCAGCCGGAGAACAACTACAAGACCACGCCTCC

CGTGCTGGACTCCGACGGCTCCTTCTTCCTCTACAGCAAGCTCACCGTGG

ACAAGAGCAGGTGGCAGCAGGGGAACGTCTTCTCATGCTCCGTGATGCAT

GAGGCTCTGCACAACCACTACACGCAGAAGAGCCTCTCCCTGTCTCCGGG

TAAATGAGTGCGACGGCCGCGACTCTAGAGGAT
```

Example 12

Production of an Antibody from an Albumin Fusion Protein

Hybridoma Technology

Antibodies that bind the albumin fusion proteins of the present invention and portions of the albumin fusion proteins of the present invention (e.g., the Therapeutic protein portion or albumin portion of the fusion protein) can be prepared by a variety of methods. (See, Current Protocols, Chapter 2.) As one example of such methods, a preparation of an albumin fusion protein of the invention or a portion of an albumin fusion protein of the invention is prepared and purified to render it substantially free of natural contaminants. Such a preparation is then introduced into an animal in order to produce polyclonal antisera of greater specific activity.

Monoclonal antibodies specific for an albumin fusion protein of the invention, or a portion of an albumin fusion protein of the invention, are prepared using hybridoma technology (Kohler et al., Nature 256:495 (1975); Kohler et al., Eur. J. Immunol. 6:511 (1976); Kohler et al., Eur. J. Immunol. 6:292 (1976); Hammerling et al., in: Monoclonal Antibodies and T-Cell Hybridomas, Elsevier, N.Y., pp. 563-681 (1981)). In general, an animal (preferably a mouse) is immunized with an albumin fusion protein of the invention, or a portion of an albumin fusion protein of the invention. The splenocytes of such mice are extracted and fused with a suitable myeloma cell line. Any suitable myeloma cell line may be employed in accordance with the present invention; however, it is preferable to employ the parent myeloma cell line (SP2O), available from the ATCC™. After fusion, the resulting hybridoma cells are selectively maintained in HAT medium, and then cloned by limiting dilution as described by Wands et al. (Gastroenterology 80:225-232 (1981)). The hybridoma cells obtained through such a selection are then assayed to identify clones which secrete antibodies capable of binding an albumin fusion protein of the invention, or a portion of an albumin fusion protein of the invention.

Alternatively, additional antibodies capable of binding to an albumin fusion protein of the invention, or a portion of an albumin fusion protein of the invention can be produced in a two-step procedure using anti-idiotypic antibodies. Such a method makes use of the fact that antibodies are themselves antigens, and therefore, it is possible to obtain an antibody which binds to a second antibody. In accordance with this method, protein specific antibodies are used to immunize an animal, preferably a mouse. The splenocytes of such an animal are then used to produce hybridoma cells, and the hybridoma cells are screened to identify clones which produce an antibody whose ability to bind to the an albumin fusion protein of the invention (or portion of an albumin fusion protein of the invention)-specific antibody can be blocked by the fusion protein of the invention, or a portion of an albumin fusion protein of the invention. Such antibodies comprise anti-idiotypic antibodies to the fusion protein of the invention (or portion of an albumin fusion protein of the invention)-specific antibody and are used to immunize an animal to induce formation of further fusion protein of the invention (or portion of an albumin fusion protein of the invention)-specific antibodies.

For in vivo use of antibodies in humans, an antibody is “humanized”. Such antibodies can be produced using genetic constructs derived from hybridoma cells producing the monoclonal antibodies described above. Methods for producing chimeric and humanized antibodies are known in the art and are discussed herein. (See, for review, Morrison, Science 229:1202 (1985); Oi et al., BioTechniques 4:214 (1986); Cabilly et al., U.S. Pat. No. 4,816,567; Taniguchi et al., EP 171496; Morrison et al., EP 173494; Neuberger et al., WO 8601533; Robinson et al., International Publication No. WO 8702671; Boulianne et al., Nature 312:643 (1984); Neuberger et al., Nature 314:268 (1985)).

Isolation Of Antibody Fragments Directed Against an albumin fusion protein of the invention, or a portion of an albumin fusion protein of the invention From A Library Of scFvs. Naturally occurring V-genes isolated from human PBLs are constructed into a library of antibody fragments which contain reactivities against an albumin fusion protein of the invention, or a portion of an albumin fusion protein of the invention, to which the donor may or may not have been exposed (see e.g., U.S. Pat. No. 5,885,793 incorporated herein by reference in its entirety).

Rescue of the Library. A library of scFvs is constructed from the RNA of human PBLs as described in International Publication No. WO 92/01047. To rescue phage displaying antibody fragments, approximately $10^9$ *E. coli* harboring the phagemid are used to inoculate 50 ml of 2×TY containing 1% glucose and 100 μg/ml of ampicillin (2×TY-AMP-GLU) and grown to an O.D. of 0.8 with shaking. Five ml of this culture is used to inoculate 50 ml of 2×TY-AMP-GLU, 2×108 TU of delta gene 3 helper (M13 delta gene III, see International Publication No. WO 92/01047) are added and the culture incubated at 37° C. for 45 minutes without shaking and then at 37° C. for 45 minutes with shaking. The culture is centrifuged at 4000 r.p.m. for 10 min. and the pellet resuspended in 2 liters of 2×TY containing 100 μg/ml ampicillin and 50 ug/ml kanamycin and grown overnight. Phage are prepared as described in International Publication No. WO 92/01047.

M13 delta gene III is prepared as follows: M13 delta gene III helper phage does not encode gene III protein, hence the phage(mid) displaying antibody fragments have a greater avidity of binding to antigen. Infectious M13 delta gene III particles are made by growing the helper phage in cells harboring a pUC19 derivative supplying the wild type gene III protein during phage morphogenesis. The culture is incubated for 1 hour at 37° C. without shaking and then for a further hour at 37° C. with shaking. Cells are spun down (IEC-Centra 8,400 r.p.m. for 10 min), resuspended in 300 ml 2×TY broth containing 100 μg ampicillin/ml and 25 μg kanamycin/ml (2×TY-AMP-KAN) and grown overnight, shaking at 37° C. Phage particles are purified and concentrated from the culture medium by two PEG-precipitations (Sambrook et al., 1990), resuspended in 2 ml PBS and passed through a 0.45 μm filter (Minisart NML; Sartorius) to give a final concentration of approximately 1013 transducing units/ml (ampicillin-resistant clones).

Panning of the Library. Immunotubes (Nunc) are coated overnight in PBS with 4 ml of either 100 μg/ml or 10 μg/ml of an albumin fusion protein of the invention, or a portion of an albumin fusion protein of the invention. Tubes are blocked with 2% Marvel-PBS for 2 hours at 37° C. and then washed 3 times in PBS. Approximately 1013 TU of phage is applied to the tube and incubated for 30 minutes at room temperature tumbling on an over and under turntable and then left to stand for another 1.5 hours. Tubes are washed 10 times with PBS 0.1% Tween-20 and 10 times with PBS. Phage are eluted by adding 1 ml of 100 mM triethylamine and rotating 15 minutes on an under and over turntable after which the solution is immediately neutralized with 0.5 ml of 1.0M Tris-HCl, pH 7.4. Phage are then used to infect 10 ml of mid-log *E. coli* TG1 by incubating eluted phage with bacteria for 30 minutes at 37° C. The *E. coli* are then plated on TYE plates containing 1% glucose and 100 μg/ml ampicillin. The resulting bacterial library is then rescued with delta gene 3 helper phage as described above to prepare phage for a subsequent round of selection. This process is then repeated for a total of 4 rounds of affinity purification with tube-washing increased to 20 times with PBS, 0.1% Tween-20 and 20 times with PBS for rounds 3 and 4.

Characterization of Binders. Eluted phage from the 3rd and 4th rounds of selection are used to infect *E. coli* HB 2151 and soluble scFv is produced (Marks, et al., 1991) from single colonies for assay. ELISAs are performed with microtitre plates coated with either 10 pg/ml of an albumin fusion protein of the invention, or a portion of an albumin fusion protein of the invention, in 50 mM bicarbonate pH 9.6. Clones positive in ELISA are further characterized by PCR fingerprinting (see, e.g., International Publication No. WO 92/01047) and then by sequencing. These ELISA positive clones may also be further characterized by techniques known in the art, such as, for example, epitope mapping, binding affinity, receptor signal transduction, ability to block or competitively inhibit antibody/antigen binding, and competitive agonistic or antagonistic activity.

Example 13

[$^3$H]-2-Deoxyglucose Uptake Assay

Adipose, skeletal muscle, and liver are insulin-sensitive tissues. Insulin can stimulate glucose uptake/transport into these tissues. In the case of adipose and skeletal muscle, insulin initiates the signal transduction that eventually leads to the translocation of the glucose transporter 4 molecule, GLUT4, from a specialized intracellular compartment to the cell surface. Once on the cell surface, GLUT4 allows for glucose uptake/transport.

[$^3$H]-2-Deoxyglucose Uptake

A number of adipose and muscle related cell-lines can be used to test for glucose uptake/transport activity in the absence or presence of a combination of any one or more of the therapeutic drugs listed for the treatment of diabetes mellitus. In particular, the 3T3-L1 murine fibroblast cells and the L6 murine skeletal muscle cells can be differentiated into 3T3-L1 adipocytes and into myotubes, respectively, to serve as appropriate in vitro models for the [$^3$H]-2-deoxyglucose uptake assay (Urso et al., J Biol Chem, 274(43): 30864-73 (1999); Wang et al., J Mol Endocrinol, 19(3): 241-8 (1997); Haspel et al., J Membr Biol, 169 (1): 45-53 (1999); Tsakiridis et al., Endocrinology, 136(10): 4315-22 (1995)). Briefly, $2\times10^5$ cells/100 μL of adipocytes or differentiated L6 cells are transferred to 96-well Tissue-Culture, "TC", treated, i.e., coated with 50 μg/mL of poly-L-lysine, plates in post-differentiation medium and are incubated overnight at 37° C. in 5% $CO_2$. The cells are first washed once with serum free low glucose DMEM medium and are then starved with 100 μL/well of the same medium and with 100 μL/well of either buffer or of a combination of any one or more of the therapeutic drugs listed for the treatment of diabetes mellitus, for example, increasing concentrations of 1 nM, 10 nM, and 100 nM of the therapeutics of the subject invention (e.g., specific fusions disclosed as SEQ ID NO:Y and fragments and variants thereof) for 16 hours at 37° C. in the absence or presence of 1 nM insulin. The plates are washed three times with 100 μL/well of HEPES buffered saline. Insulin is added at 1 nM in HEPES buffered saline for 30 min at 37° C. in the presence of 10 μM labeled [$^3$H]-2-deoxyglucose (Amersham, #TRK672) and 10 μM unlabeled 2-deoxyglucose (SIGMA, D-3179). As control, the same conditions are carried out except in the absence of insulin. A final concentration of 10 μM cytochalasin B (SIGMA, C6762) is added at 100 μL/well in a separate well to measure the non-specific uptake. The cells are washed three times with HEPES buffered saline. Labeled, i.e., 10 μM of [$^3$H]-2-deoxyglucose, and unlabeled, i.e., 10 μM of 2-deoxyglucose, are added for 10 minutes at room temperature. The cells are washed three times with cold Phosphate Buffered Sal ine, "PBS". The cells are lysed upon the addition of 150 μL/well of 0.2 N NaOH and subsequent incubation with shaking for 20 minutes at room temperature. Samples are then transferred to a scintillation vial to which is added 5 mL of scintillation fluid. The vials are counted in a Beta-Scintillation counter. Uptake in duplicate conditions, the difference being the absence or presence of insulin, is determined with the following equation: [(Insulin counts per minute "cpm"−Non-Specific cpm)/(No Insulin cpm−Non-Specific cpm)]. Average responses fall within the limits of about 5-fold and 3-fold that of controls for adipocytes and myotubes, respectively.

Differentiation of Cells

The cells are allowed to become fully confluent in a T-75 $cm^2$ flask. The medium is removed and replaced with 25 mL of pre-differentiation medium for 48 hours. The cells are incubated at 37° C., in 5% $CO_2$, 85% humidity. After 48 hours, the pre-differentiation medium is removed and replaced with 25 mL differentiation medium for 48 hours. The cells are again incubated at 37° C., in 5% $CO_2$, 85% humidity. After 48 hours, the medium is removed and replaced with 30 mL post-differentiation medium. Post-differentiation medium is maintained for 14-20 days or until complete differentiation is achieved. The medium is changed every 2-3 days. Human adipocytes can be purchased from Zen-Bio, INC (#SA-1096).

Example 14

In Vitro Assay of [$^3$H]-Thymidine Incorporation into Pancreatic Cell-Lines

It has recently been shown that GLP-1 induces differentiation of the rat pancreatic ductal epithelial cell-line ARIP in a time- and dose-dependent manner which is associated with an increase in Islet Duodenal Homeobox-1 (IDX-1) and insulin mRNA levels (Hui et al., 2001, Diabetes, 50(4): 785-96). The IDX-1 in turn increases mRNA levels of the GLP-1 receptor.

Cells Types Tested

RIN-M cells: These cells are available from the American Type Tissue Culture Collection (ATCC™ Cell Line Number CRL-2057). The RIN-M cell line was derived from a radiation induced transplantable rat islet cell tumor. The line was established from a nude mouse xenograft of the tumor. The cells produce and secrete islet polypeptide hormones, and produce L-dopa decarboxylase (a marker for cells having amine precursor uptake and decarboxylation, or APUD, activity).

ARIP cells: These are pancreatic exocrine cells of epithelial morphology available from the American Type Tissue Culture Collection (ATCC™ Cell Line Number CRL-1674). See also, references: Jessop, N. W. and Hay, R. J., "Characteristics of two rat pancreatic exocrine cell lines derived from transplantable tumors," In Vitro 16: 212, (1980); Cockell, M. et al., "Identification of a cell-specific DNA-binding activity that interacts with a transcriptional activator of genes expressed in the acinar pancreas," Mol. Cell. Biol. 9: 2464-2476, (1989); Roux, E., et al. "The cell-specific transcription factor PTF1 contains two different subunits that interact with the DNA" Genes Dev. 3: 1613-1624, (1989); and, Hui, H., et al., "Glucagon-like peptide 1 induces differentiation of islet duodenal homeobox-1-positive pancreatic ductal cells into insulin-secreting cells," Diabetes 50: 785-796 (2001).

Preparation of Cells

The RIN-M cell-line is grown in RPMI 1640 medium (Hyclone, #SH300027.01) with 10% fetal bovine serum (HyClone, #SH30088.03) and is subcultured every 6 to 8 days at a ratio of 1:3 to 1:6. The medium is changed every 3 to 4 days.

The ARIP (ATCC™ #CRL-1674) cell-line is grown in Ham's F12K medium (ATCC™, #30-2004) with 2 mM L-glutamine adjusted to contain 1.5 g/L sodium bicarbonate and 10% fetal bovine serum. The ARIP cell-line is subcultured at a ratio of 1:3 to 1:6 twice per week. The medium is changed every 3 to 4 days.

Assay Protocol

The cells are seeded at 4000 cells/well in 96-well plates and cultured for 48 to 72 hours to 50% confluence. The cells are switched to serum-free media at 100 μL/well. After incubation for 48-72 hours, serum and/or the therapeutics of the subject invention (e.g., albumin fusion proteins of the invention and fragments and variants thereof) are added to the well. Incubation persists for an additional 36 hours. [$^3$H]-Thymidine (5-20 Ci/mmol) (Amersham Pharmacia, #TRK120) is diluted to 1 microCuries/5 microliters. After the 36 hour incubation, 5 microliters is added per well for a further 24 hours. The reaction is terminated by washing the cells gently with cold Phosphate-Buffered Sal ine, "PBS", once. The cells are then fixed with 100 microliters of 10% ice cold TCA for 15 min at 4° C. The PBS is removed and 200 microliters of 0.2 N NaOH is added. The plates are incubated for 1 hour at room temperature with shaking. The solution is transferred to a scintillation vial and 5 mL of scintillation fluid compatible with aqueous solutions is added and mixed vigorously. The vials are counted in a beta scintillation counter. As negative control, only buffer is used. As a positive control fetal calf serum is used.

Example 15

Assaying for Glycosuria

Glycosuria (i.e., excess sugar in the urine), can be readily assayed to provide an index of the disease state of diabetes mellitus. Excess urine in a patient sample as compared with a normal patient sample is symptomatic of IDDM and NIDDM. Efficacy of treatment of such a patient having IDDM and NIDDM is indicated by a resulting decrease in the amount of excess glucose in the urine. In a preferred embodiment for IDDM and NIDDM monitoring, urine samples from patients are assayed for the presence of glucose using techniques known in the art. Glycosuria in humans is defined by a urinary glucose concentration exceeding 100 mg per 100 ml. Excess sugar levels in those patients exhibiting glycosuria can be measured even more precisely by obtaining blood samples and assaying serum glucose.

Example 16

Assays Detecting Stimulation or Inhibition of B Cell Proliferation and Differentiation Generation of functional humoral immune responses requires both soluble and cognate signaling between B-lineage cells and their microenvironment. Signals may impart a positive stimulus that allows a B-lineage cell to continue its programmed development, or a negative stimulus that instructs the cell to arrest its current developmental pathway. To date, numerous stimulatory and inhibitory signals have been found to influence B cell responsiveness including IL-2, IL-4, IL-5, IL-6, IL-7, IL10, IL-13, IL-14 and IL-15. Interestingly, these signals are by themselves weak effectors but can, in combination with various co-stimulatory proteins, induce activation, proliferation, differentiation, homing, tolerance and death among B cell populations.

One of the best studied classes of B-cell co-stimulatory proteins is the TNF-superfamily. Within this family CD40, CD27, and CD30 along with their respective ligands CD154, CD70, and CD153 have been found to regulate a variety of immune responses. Assays which allow for the detection and/or observation of the proliferation and differentiation of these B-cell populations and their precursors are valuable tools in determining the effects various proteins may have on these B-cell populations in terms of proliferation and differentiation. Listed below are two assays designed to allow for the detection of the differentiation, proliferation, or inhibition of B-cell populations and their precursors.

In Vitro Assay—Albumin fusion proteins of the invention (including fusion proteins containing fragments or variants of Therapeutic proteins and/or albumin or fragments or variants of albumin) can be assessed for its ability to induce activation, proliferation, differentiation or inhibition and/or death in B-cell populations and their precursors. The activity of an albumin fusion protein of the invention on purified human tonsillar B cells, measured qualitatively over the dose range from 0.1 to 10,000 ng/mL, is assessed in a standard B-lymphocyte co-stimulation assay in which purified tonsillar B cells are cultured in the presence of either formalin-fixed *Staphylococcus aureus* Cowan I (SAC) or immobilized anti-human IgM antibody as the priming agent. Second signals such as IL-2 and IL-15 synergize with SAC and IgM crosslinking to elicit B cell proliferation as measured by tritiated-thymidine incorporation. Novel synergizing agents can be readily identified using this assay. The assay involves isolating human tonsillar B cells by magnetic bead (MACS) depletion of CD3-positive cells. The resulting cell population is greater than 95% B cells as assessed by expression of CD45R(B220).

Various dilutions of each sample are placed into individual wells of a 96-well plate to which are added $10^5$ B-cells suspended in culture medium (RPMI 1640 containing 10% FBS, $5\times10^{-5}$M 2ME, 100 U/ml penicillin, 10 ug/ml streptomycin, and $10^{-5}$ dilution of SAC) in a total volume of 150 ul. Proliferation or inhibition is quantitated by a 20 h pulse (1 uCi/well) with 3H-thymidine (6.7 Ci/mM) beginning 72 h post factor addition. The positive and negative controls are IL2 and medium respectively.

In vivo Assay—BALB/c mice are injected (i.p.) twice per day with buffer only, or 2 mg/Kg of an albumin fusion protein of the invention (including fusion proteins containing fragments or variants of Therapeutic proteins and/or albumin or fragments or variants of albumin). Mice receive this treatment for 4 consecutive days, at which time they are sacrificed and various tissues and serum collected for analyses. Comparison of H&E sections from normal spleens and spleens treated with the albumin fusion protein of the invention identify the results of the activity of the fusion protein on spleen cells, such as the diffusion of peri-arterial lymphatic sheaths, and/or significant increases in the nucleated cellularity of the red pulp regions, which may indicate the activation of the differentiation and proliferation of B-cell populations. Immunohistochemical studies using a B cell marker, anti-CD45R(B220), are used to determine whether any physiological changes to splenic cells, such as splenic disorganization, are due to increased B-cell representation within loosely defined B-cell zones that infiltrate established T-cell regions.

Flow cytometric analyses of the spleens from mice treated with the albumin fusion protein is used to indicate whether the albumin fusion protein specifically increases the proportion of ThB+, CD45R(B220)dull B cells over that which is observed in control mice.

Likewise, a predicted consequence of increased mature B-cell representation in vivo is a relative increase in serum Ig titers. Accordingly, serum IgM and IgA levels are compared between buffer and fusion protein treated mice.

Example 17

T Cell Proliferation Assay

A CD3-induced proliferation assay is performed on PBMCs and is measured by the uptake of $^3$H-thymidine. The assay is performed as follows. Ninety-six well plates are coated with 100 μl/well of mAb to CD3 (HIT3a, Pharmingen) or isotype-matched control mAb (B33.1) overnight at 4 degrees C. (1 μg/ml in 0.05M bicarbonate buffer, pH 9.5), then washed three times with PBS. PBMC are isolated by F/H gradient centrifugation from human peripheral blood and added to quadruplicate wells ($5\times10^4$/well) of mAb coated plates in RPMI containing 10% FCS and P/S in the presence of varying concentrations of an albumin fusion protein of the invention (including fusion proteins containing fragments or variants of Therapeutic proteins and/or albumin or fragments or variants of albumin) (total volume 200 ul). Relevant protein buffer and medium alone are controls. After 48 hr. culture at 37 degrees C., plates are spun for 2 min. at 1000 rpm and 100 μl of supernatant is removed and stored 20 degrees C. for measurement of IL-2 (or other cytokines) if effect on proliferation is observed. Wells are supplemented with 100 ul of medium containing 0.5 uCi of $^3$H-thymidine and cultured at 37 degrees C. for 18-24 hr. Wells are harvested and incorporation of $^3$H-thymidine used as a measure of proliferation. Anti-CD3 alone is the positive control for proliferation. IL-2 (100 U/ml) is also used as a control which enhances proliferation. Control antibody which does not induce proliferation of T cells is used as the negative control for the effects of fusion proteins of the invention.

Example 18

Effect of Fusion Proteins of the Invention on the Expression of MHC Class II, Costimulatory and Adhesion Molecules and Cell Differentiation of Monocytes and Monocyte-Derived Human Dendritic Cells Dendritic cells are generated by the expansion of proliferating precursors found in the peripheral blood: adherent PBMC or elutriated monocytic fractions are cultured for 7-10 days with GM-CSF (50 ng/ml) and IL-4 (20 ng/ml). These dendritic cells have the characteristic phenotype of immature cells (expression of CD1, CD80, CD86, CD40 and MHC class II antigens). Treatment with activating factors, such as TNF-α, causes a rapid change in surface phenotype (increased expression of MHC class I and II, costimulatory and adhesion molecules, downregulation of FCγRII, upregulation of CD83). These changes correlate with increased antigen-presenting capacity and with functional maturation of the dendritic cells.

FACS analysis of surface antigens is performed as follows. Cells are treated 1-3 days with increasing concentrations of an albumin fusion protein of the invention or LPS (positive control), washed with PBS containing 1% BSA and 0.02 mM sodium azide, and then incubated with 1:20 dilution of appropriate FITC- or PE-labeled monoclonal antibodies for 30 minutes at 4 degrees C. After an additional wash, the labeled cells are analyzed by flow cytometry on a FACScan (Becton Dickinson).

Effect on the production of cytokines. Cytokines generated by dendritic cells, in particular IL-12, are important in the initiation of T-cell dependent immune responses. IL-12 strongly influences the development of Th1 helper T-cell immune response, and induces cytotoxic T and NK cell function. An ELISA is used to measure the IL-12 release as follows. Dendritic cells ($10^6$/ml) are treated with increasing concentrations of an albumin fusion protein of the invention for 24 hours. LPS (100 ng/ml) is added to the cell culture as positive control. Supernatants from the cell cultures are then collected and analyzed for IL-12 content using commercial ELISA kit (e.g., R & D Systems (Minneapolis, Minn.)). The standard protocols provided with the kits are used.

Effect on the expression of MHC Class II, costimulatory and adhesion molecules. Three major families of cell surface antigens can be identified on monocytes: adhesion molecules, molecules involved in antigen presentation, and Fc receptor. Modulation of the expression of MHC class II antigens and other costimulatory molecules, such as B7 and ICAM-1, may result in changes in the antigen presenting capacity of monocytes and ability to induce T cell activation. Increased expression of Fc receptors may correlate with improved monocyte cytotoxic activity, cytokine release and phagocytosis.

FACS analysis is used to examine the surface antigens as follows. Monocytes are treated 1-5 days with increasing concentrations of an albumin fusion protein of the invention or LPS (positive control), washed with PBS containing 1% BSA and 0.02 mM sodium azide, and then incubated with 1:20 dilution of appropriate FITC- or PE-labeled monoclonal antibodies for 30 minutes at 4 degrees C. After an additional wash, the labeled cells are analyzed by flow cytometry on a FACScan (Becton Dickinson).

Monocyte activation and/or increased survival. Assays for molecules that activate (or alternatively, inactivate) monocytes and/or increase monocyte survival (or alternatively, decrease monocyte survival) are known in the art and may routinely be applied to determine whether a molecule of the invention functions as an inhibitor or activator of monocytes. Albumin fusion proteins of the invention can be screened using the three assays described below. For each of these assays, Peripheral blood mononuclear cells (PBMC) are purified from single donor leukopacks (American Red Cross, Baltimore, Md.) by centrifugation through a Histopaque gradient (Sigma). Monocytes are isolated from PBMC by counterflow centrifugal elutriation.

Monocyte Survival Assay. Human peripheral blood monocytes progressively lose viability when cultured in absence of serum or other stimuli. Their death results from internally regulated processes (apoptosis). Addition to the culture of activating factors, such as TNF-alpha dramatically improves cell survival and prevents DNA fragmentation. Propidium iodide (PI) staining is used to measure apoptosis as follows. Monocytes are cultured for 48 hours in polypropylene tubes in serum-free medium positive control), in the presence of 100 ng/ml TNF-alpha (negative control), and in the presence of varying concentrations of the fusion protein to be tested. Cells are suspended at a concentration of $2\times10^6$/ml in PBS containing PI at a final concentration of 5 μg/ml, and then incubated at room temperature for 5 minutes before FACScan analysis. PI uptake has been demonstrated to correlate with DNA fragmentation in this experimental paradigm.

Effect on cytokine release. An important function of monocytes/macrophages is their regulatory activity on other cellular populations of the immune system through the release of cytokines after stimulation. An ELISA to measure cytokine release is performed as follows. Human monocytes are incubated at a density of $5\times10^5$ cells/ml with increasing concentrations of an albumin fusion protein of the invention and under the same conditions, but in the absence of the fusion protein. For IL-12 production, the cells are primed overnight with IFN (100 U/ml) in the presence of the fusion protein. LPS (10 ng/ml) is then added. Conditioned media are collected after 24 h and kept frozen until use. Measurement of TNF-alpha, IL-10, MCP-1 and IL-8 is then performed using a commercially available ELISA kit (e.g., R & D Systems (Minneapolis, Minn.)) and applying the standard protocols provided with the kit.

Oxidative burst. Purified monocytes are plated in 96-w plate at 2-1×10$^5$ cell/well. Increasing concentrations of an albumin fusion protein of the invention are added to the wells in a total volume of 0.2 ml culture medium (RPMI 1640+10% FCS, glutamine and antibiotics). After 3 days incubation, the plates are centrifuged and the medium is removed from the wells. To the macrophage monolayers, 0.2 ml per well of phenol red solution (140 mM NaCl, 10 mM potassium phosphate buffer pH 7.0, 5.5 mM dextrose, 0.56 mM phenol red and 19 U/ml of HRPO) is added, together with the stimulant (200 nM PMA). The plates are incubated at 37° C. for 2 hours and the reaction is stopped by adding 20 μl 1N NaOH per well. The absorbance is read at 610 nm. To calculate the amount of $H_2O_2$ produced by the macrophages, a standard curve of a $H_2O_2$ solution of known molarity is performed for each experiment.

Example 19

The Effect of Albumin Fusion Proteins of the Invention on the Growth of Vascular Endothelial Cells On day 1, human umbilical vein endothelial cells (HUVEC) are seeded at 2-5×10$^4$ cells/35 mm dish density in M199 medium containing 4% fetal bovine serum (FBS), 16 units/ml heparin, and 50 units/ml endothelial cell growth supplements (ECGS, Biotechnique, Inc.). On day 2, the medium is replaced with M199 containing 10% FBS, 8 units/ml heparin. An albumin fusion protein of the invention, and positive controls, such as VEGF and basic FGF (bFGF) are added, at varying concentrations. On days 4 and 6, the medium is replaced. On day 8, cell number is determined with a Coulter Counter.

An increase in the number of HUVEC cells indicates that the fusion protein may proliferate vascular endothelial cells, while a decrease in the number of HUVEC cells indicates that the fusion protein inhibits vascular endothelial cells.

Example 20

Rat Corneal Wound Healing Model

This animal model shows the effect of an albumin fusion protein of the invention on neovascularization. The experimental protocol includes:

Making a 1-1.5 mm long incision from the center of cornea into the stromal layer.

Inserting a spatula below the lip of the incision facing the outer corner of the eye.

Making a pocket (its base is 1-1.5 mm form the edge of the eye).

Positioning a pellet, containing 50 ng-5 ug of an albumin fusion protein of the invention, within the pocket.

Treatment with an albumin fusion protein of the invention can also be applied topically to the corneal wounds in a dosage range of 20 mg-500 mg (daily treatment for five days).

Example 21

Diabetic Mouse and Glucocorticoid-Impaired Wound Healing Models

Diabetic db+/db+ Mouse Model.

To demonstrate that an albumin fusion protein of the invention accelerates the healing process, the genetically diabetic mouse model of wound healing is used. The full thickness wound healing model in the db+/db+ mouse is a well characterized, clinically relevant and reproducible model of impaired wound healing. Healing of the diabetic wound is dependent on formation of granulation tissue and re-epithelialization rather than contraction (Gartner, M. H. et al., *J. Surg. Res.* 52:389 (1992); Greenhalgh, D. G. et al., *Am. J. Pathol.* 136:1235 (1990)).

The diabetic animals have many of the characteristic features observed in Type II diabetes mellitus. Homozygous (db+/db+) mice are obese in comparison to their normal heterozygous (db+/+m) littermates. Mutant diabetic (db+/db+) mice have a single autosomal recessive mutation on chromosome 4 (db+) (Coleman et al. *Proc. Natl. Acad. Sci. USA* 77:283-293 (1982)). Animals show polyphagia, polydipsia and polyuria. Mutant diabetic mice (db+/db+) have elevated blood glucose, increased or normal insulin levels, and suppressed cell-mediated immunity (Mandel et al., *J. Immunol.* 120:1375 (1978); Debray-Sachs, M. et al., Clin. Exp. Immunol. 51(1):1-7 (1983); Leiter et al., *Am. J. of Pathol.* 114:46-55 (1985)). Peripheral neuropathy, myocardial complications, and microvascular lesions, basement membrane thickening and glomerular filtration abnormalities have been described in these animals (Norido, F. et al., *Exp. Neurol.* 83(2):221-232 (1984); Robertson et al., *Diabetes* 29(1):60-67 (1980); Giacomelli et al., *Lab Invest.* 40(4):460-473 (1979); Coleman, D. L., *Diabetes* 31 (*Suppl*):1-6 (1982)). These homozygous diabetic mice develop hyperglycemia that is resistant to insulin analogous to human type II diabetes (Mandel et al., *J. Immunol.* 120:1375-1377 (1978)).

The characteristics observed in these animals suggests that healing in this model may be similar to the healing observed in human diabetes (Greenhalgh, et al., *Am. J. of Pathol.* 136:1235-1246 (1990)).

Genetically diabetic female C57BL/KsJ (db+/db+) mice and their non-diabetic (db+/+m) heterozygous littermates are used in this study (Jackson Laboratories). The animals are purchased at 6 weeks of age and are 8 weeks old at the beginning of the study. Animals are individually housed and received food and water ad libitum. All manipulations are performed using aseptic techniques. The experiments are conducted according to the rules and guidelines of Human Genome Sciences, Inc. Institutional Animal Care and Use Committee and the Guidelines for the Care and Use of Laboratory Animals.

Wounding protocol is performed according to previously reported methods (Tsuboi, R. and Rifkin, D. B., *J. Exp. Med.* 172:245-251 (1990)). Briefly, on the day of wounding, animals are anesthetized with an intraperitoneal injection of Avertin (0.01 mg/mL), 2,2,2-tribromoethanol and 2-methyl-2-butanol dissolved in deionized water. The dorsal region of the animal is shaved and the skin washed with 70% ethanol solution and iodine. The surgical area is dried with sterile gauze prior to wounding. An 8 mm full-thickness wound is then created using a Keyes tissue punch. Immediately following wounding, the surrounding skin is gently stretched to eliminate wound expansion. The wounds are left open for the duration of the experiment. Application of the treatment is given topically for 5 consecutive days commencing on the day of wounding. Prior to treatment, wounds are gently cleansed with sterile saline and gauze sponges.

Wounds are visually examined and photographed at a fixed distance at the day of surgery and at two day intervals thereafter. Wound closure is determined by daily measurement on days 1-5 and on day 8. Wounds are measured horizontally and vertically using a calibrated Jameson caliper. Wounds are considered healed if granulation tissue is no longer visible and the wound is covered by a continuous epithelium.

An albumin fusion protein of the invention is administered using at a range different doses, from 4 mg to 500 mg per wound per day for 8 days in vehicle. Vehicle control groups received 50 mL of vehicle solution.

Animals are euthanized on day 8 with an intraperitoneal injection of sodium pentobarbital (300 mg/kg). The wounds and surrounding skin are then harvested for histology and immunohistochemistry. Tissue specimens are placed in 10% neutral buffered formalin in tissue cassettes between biopsy sponges for further processing.

Three groups of 10 animals each (5 diabetic and 5 non-diabetic controls) are evaluated: 1) Vehicle placebo control, 2) untreated group, and 3) treated group.

Wound closure is analyzed by measuring the area in the vertical and horizontal axis and obtaining the total square area of the wound. Contraction is then estimated by establishing the differences between the initial wound area (day 0) and that of post treatment (day 8). The wound area on day 1 is 64 $mm^2$, the corresponding size of the dermal punch. Calculations are made using the following formula:

[Open area on day 8]−[Open area on day 1]/[Open area on day 1] a.

Specimens are fixed in 10% buffered formalin and paraffin embedded blocks are sectioned perpendicular to the wound surface (5 mm) and cut using a Reichert-Jung microtome. Routine hematoxylin-eosin (H&E) staining is performed on cross-sections of bisected wounds. Histologic examination of the wounds are used to assess whether the healing process and the morphologic appearance of the repaired skin is altered by treatment with an albumin fusion protein of the invention. This assessment included verification of the presence of cell accumulation, inflammatory cells, capillaries, fibroblasts, re-epithelialization and epidermal maturity (Greenhalgh, D. G. et al., *Am. J. Pathol.* 136:1235 (1990)). A calibrated lens micrometer is used by a blinded observer.

Tissue sections are also stained immunohistochemically with a polyclonal rabbit anti-human keratin antibody using ABC Elite detection system. Human skin is used as a positive tissue control while non-immune IgG is used as a negative control. Keratinocyte growth is determined by evaluating the extent of reepithelialization of the wound using a calibrated lens micrometer.

Proliferating cell nuclear antigen/cyclin (PCNA) in skin specimens is demonstrated by using anti-PCNA antibody (1:50) with an ABC Elite detection system. Human colon cancer served as a positive tissue control and human brain tissue is used as a negative tissue control. Each specimen included a section with omission of the primary antibody and substitution with non-immune mouse IgG. Ranking of these sections is based on the extent of proliferation on a scale of 0-8, the lower side of the scale reflecting slight proliferation to the higher side reflecting intense proliferation.

Experimental data are analyzed using an unpaired t test. A p value of <0.05 is considered significant.

Steroid Impaired Rat Model

The inhibition of wound healing by steroids has been well documented in various in vitro and in vivo systems (Wahl, Glucocorticoids and Wound healing. In: Anti-Inflammatory Steroid Action: Basic and Clinical Aspects. 280-302 (1989); Wahl et al., *J. Immunol.* 115: 476-481 (1975); Werb et al., *J. Exp. Med.* 147:1684-1694 (1978)). Glucocorticoids retard wound healing by inhibiting angiogenesis, decreasing vascular permeability (Ebert et al., *An. Intern. Med.* 37:701-705 (1952)), fibroblast proliferation, and collagen synthesis (Beck et al., *Growth Factors.* 5: 295-304 (1991); Haynes et al., *J. Clin. Invest.* 61: 703-797 (1978)) and producing a transient reduction of circulating monocytes (Haynes et al., *J. Clin. Invest.* 61: 703-797 (1978); Wahl, "Glucocorticoids and wound healing", In: Antiinflammatory Steroid Action: Basic and Clinical Aspects, Academic Press, New York, pp. 280-302 (1989)). The systemic administration of steroids to impaired wound healing is a well establish phenomenon in rats (Beck et al., *Growth Factors.* 5: 295-304 (1991); Haynes et al., *J. Clin. Invest.* 61: 703-797 (1978); Wahl, "Glucocorticoids and wound healing", In: Antiinflammatory Steroid Action: Basic and Clinical Aspects, Academic Press, New York, pp. 280-302 (1989); Pierce et al., *Proc. Natl. Acad. Sci. USA* 86: 2229-2233 (1989)).

To demonstrate that an albumin fusion protein of the invention can accelerate the healing process, the effects of multiple topical applications of the fusion protein on full thickness excisional skin wounds in rats in which healing has been impaired by the systemic administration of methylprednisolone is assessed.

Young adult male Sprague Dawley rats weighing 250-300 g (Charles River Laboratories) are used in this example. The animals are purchased at 8 weeks of age and are 9 weeks old at the beginning of the study. The healing response of rats is impaired by the systemic administration of methylprednisolone (17 mg/kg/rat intramuscularly) at the time of wounding. Animals are individually housed and received food and water ad libitum. All manipulations are performed using aseptic techniques. This study is conducted according to the rules and guidelines of Human Genome Sciences, Inc. Institutional Animal Care and Use Committee and the Guidelines for the Care and Use of Laboratory Animals.

The wounding protocol is followed according to that described above. On the day of wounding, animals are anesthetized with an intramuscular injection of ketamine (50 mg/kg) and xylazine (5 mg/kg). The dorsal region of the animal is shaved and the skin washed with 70% ethanol and iodine solutions. The surgical area is dried with sterile gauze prior to wounding. An 8 mm full-thickness wound is created using a Keyes tissue punch. The wounds are left open for the duration of the experiment. Applications of the testing materials are given topically once a day for 7 consecutive days commencing on the day of wounding and subsequent to methylprednisolone administration. Prior to treatment, wounds are gently cleansed with sterile saline and gauze sponges.

Wounds are visually examined and photographed at a fixed distance at the day of wounding and at the end of treatment. Wound closure is determined by daily measurement on days 1-5 and on day 8. Wounds are measured horizontally and vertically using a calibrated Jameson caliper. Wounds are considered healed if granulation tissue is no longer visible and the wound is covered by a continuous epithelium.

The fusion protein of the invention is administered using at a range different doses, from 4 mg to 500 mg per wound per day for 8 days in vehicle. Vehicle control groups received 50 mL of vehicle solution.

Animals are euthanized on day 8 with an intraperitoneal injection of sodium pentobarbital (300 mg/kg). The wounds and surrounding skin are then harvested for histology. Tissue specimens are placed in 10% neutral buffered formalin in tissue cassettes between biopsy sponges for further processing.

Three groups of 10 animals each (5 with methylprednisolone and 5 without glucocorticoid) are evaluated: 1) Untreated group 2) Vehicle placebo control 3) treated groups.

Wound closure is analyzed by measuring the area in the vertical and horizontal axis and obtaining the total area of the wound. Closure is then estimated by establishing the differences between the initial wound area (day 0) and that of post treatment (day 8). The wound area on day 1 is 64 $mm^2$, the corresponding size of the dermal punch. Calculations are made using the following formula:

[Open area on day 8]−[Open area on day 1]/[Open area on day 1] b.

Specimens are fixed in 10% buffered formalin and paraffin embedded blocks are sectioned perpendicular to the wound surface (5 mm) and cut using an Olympus microtome. Routine hematoxylin-eosin (H&E) staining is performed on cross-sections of bisected wounds. Histologic examination of the wounds allows assessment of whether the healing process and the morphologic appearance of the repaired skin is improved by treatment with an albumin fusion protein of the invention. A calibrated lens micrometer is used by a blinded observer to determine the distance of the wound gap.

Experimental data are analyzed using an unpaired t test. A p value of <0.05 is considered significant.

Example 22

Lymphedema Animal Model

The purpose of this experimental approach is to create an appropriate and consistent lymphedema model for testing the therapeutic effects of an albumin fusion protein of the invention in lymphangiogenesis and re-establishment of the lymphatic circulatory system in the rat hind limb. Effectiveness is measured by swelling volume of the affected limb, quantification of the amount of lymphatic vasculature, total blood plasma protein, and histopathology. Acute lymphedema is observed for 7-10 days. Perhaps more importantly, the chronic progress of the edema is followed for up to 3-4 weeks.

Prior to beginning surgery, blood sample is drawn for protein concentration analysis. Male rats weighing approximately ~350 g are dosed with Pentobarbital. Subsequently, the right legs are shaved from knee to hip. The shaved area is swabbed with gauze soaked in 70% EtOH. Blood is drawn for serum total protein testing. Circumference and volumetric measurements are made prior to injecting dye into paws after marking 2 measurement levels (0.5 cm above heel, at mid-pt of dorsal paw). The intradermal dorsum of both right and left paws are injected with 0.05 ml of 1% Evan's Blue. Circumference and volumetric measurements are then made following injection of dye into paws.

Using the knee joint as a landmark, a mid-leg inguinal incision is made circumferentially allowing the femoral vessels to be located. Forceps and hemostats are used to dissect and separate the skin flaps. After locating the femoral vessels, the lymphatic vessel that runs along side and underneath the vessel(s) is located. The main lymphatic vessels in this area are then electrically coagulated or suture ligated.

Using a microscope, muscles in back of the leg (near the semitendinosis and adductors) are bluntly dissected. The popliteal lymph node is then located. The 2 proximal and 2 distal lymphatic vessels and distal blood supply of the popliteal node are then ligated by suturing. The popliteal lymph node, and any accompanying adipose tissue, is then removed by cutting connective tissues.

Care is taken to control any mild bleeding resulting from this procedure. After lymphatics are occluded, the skin flaps are sealed by using liquid skin (Vetbond) (AJ Buck). The separated skin edges are sealed to the underlying muscle tissue while leaving a gap of ~0.5 cm around the leg. Skin also may be anchored by suturing to underlying muscle when necessary.

To avoid infection, animals are housed individually with mesh (no bedding). Recovering animals are checked daily through the optimal edematous peak, which typically occurred by day 5-7. The plateau edematous peak are then observed. To evaluate the intensity of the lymphedema, the circumference and volumes of 2 designated places on each paw before operation and daily for 7 days are measured. The effect of plasma proteins on lymphedema is determined and whether protein analysis is a useful testing perimeter is also investigated. The weights of both control and edematous limbs are evaluated at 2 places. Analysis is performed in a blind manner.

Circumference Measurements Under brief gas anesthetic to prevent limb movement, a cloth tape is used to measure limb circumference. Measurements are done at the ankle bone and dorsal paw by 2 different people and those 2 readings are averaged. Readings are taken from both control and edematous limbs.

Volumetric Measurements On the day of surgery, animals are anesthetized with Pentobarbital and are tested prior to surgery. For daily volumetrics animals are under brief halothane anesthetic (rapid immobilization and quick recovery), and both legs are shaved and equally marked using waterproof marker on legs. Legs are first dipped in water, then dipped into instrument to each marked level then measured by Buxco edema software (Chen/Victor). Data is recorded by one person, while the other is dipping the limb to marked area.

Blood-plasma protein measurements: Blood is drawn, spun, and serum separated prior to surgery and then at conclusion for total protein and $Ca2^{+}$ comparison.

Limb Weight Comparison: After drawing blood, the animal is prepared for tissue collection. The limbs are amputated using a quillitine, then both experimental and control legs are cut at the ligature and weighed. A second weighing is done as the tibio-cacaneal joint is disarticulated and the foot is weighed.

Histological Preparations The transverse muscle located behind the knee (popliteal) area is dissected and arranged in a metal mold, filled with freezeGel, dipped into cold methylbutane, placed into labeled sample bags at −80EC until sectioning. Upon sectioning, the muscle is observed under fluorescent microscopy for lymphatics.

Example 23

Suppression of TNF Alpha-Induced Adhesion Molecule Expression by an Albumin Fusion Protein of the Invention The recruitment of lymphocytes to areas of inflammation and angiogenesis involves specific receptor-ligand interactions between cell surface adhesion molecules (CAMs) on lymphocytes and the vascular endothelium. The adhesion process, in both normal and pathological settings, follows a multi-step cascade that involves intercellular adhesion molecule-1 (ICAM-1), vascular cell adhesion molecule-1 (VCAM-1), and endothelial leukocyte adhesion molecule-1 (E-selectin) expression on endothelial cells (EC). The expression of these molecules and others on the vascular endothelium determines the efficiency with which leukocytes may adhere to the local vasculature and extravasate into the local tissue during the development of an inflammatory response. The local concentration of cytokines and growth factor participate in the modulation of the expression of these CAMs.

Tumor necrosis factor alpha (TNF-a), a potent proinflammatory cytokine, is a stimulator of all three CAMs on endothelial cells and may be involved in a wide variety of inflammatory responses, often resulting in a pathological outcome.

The potential of an albumin fusion protein of the invention to mediate a suppression of TNF-a induced CAM expression can be examined. A modified ELISA assay which uses ECs as a solid phase absorbent is employed to measure the amount of CAM expression on TNF-a treated ECs when co-stimulated with a member of the FGF family of proteins.

To perform the experiment, human umbilical vein endothelial cell (HUVEC) cultures are obtained from pooled cord harvests and maintained in growth medium (EGM-2; Clonetics, San Diego, Calif.) supplemented with 10% FCS and 1% penicillin/streptomycin in a 37 degree C. humidified incubator containing 5% $CO_2$. HUVECs are seeded in 96-well plates at concentrations of $1\times10^4$ cells/well in EGM medium at 37 degree C. for 18-24 hrs or until confluent. The monolayers are subsequently washed 3 times with a serum-free solution of RPMI-1640 supplemented with 100 U/ml penicillin and 100 mg/ml streptomycin, and treated with a given cytokine and/or growth factor(s) for 24 h at 37 degree C. Following incubation, the cells are then evaluated for CAM expression.

Human Umbilical Vein Endothelial cells (HUVECs) are grown in a standard 96 well plate to confluence. Growth medium is removed from the cells and replaced with 90 ul of 199 Medium (10% FBS). Samples for testing and positive or negative controls are added to the plate in triplicate (in 10 ul volumes). Plates are incubated at 37 degree C. for either 5 h (selectin and integrin expression) or 24 h (integrin expression only). Plates are aspirated to remove medium and 100 µl of 0.1% paraformaldehyde-PBS(with $Ca^{++}$ and $Mg^{++}$) is added to each well. Plates are held at 4° C. for 30 min.

Fixative is then removed from the wells and wells are washed 1× with PBS(+Ca,Mg)+0.5% BSA and drained. Do not allow the wells to dry. Add 10 µl of diluted primary antibody to the test and control wells. Anti-ICAM-1-Biotin, Anti-VCAM-1-Biotin and Anti-E-selectin-Biotin are used at a concentration of 10 µg/ml (1:10 dilution of 0.1 mg/ml stock antibody). Cells are incubated at 37° C. for 30 min. in a humidified environment. Wells are washed ×3 with PBS(+Ca, Mg)+0.5% BSA.

Then add 20 µl of diluted ExtrAvidin-Alkaline Phosphotase (1:5,000 dilution) to each well and incubated at 37° C. for 30 min. Wells are washed ×3 with PBS(+Ca,Mg)+0.5% BSA. 1 tablet of p-Nitrophenol Phosphate pNPP is dissolved in 5 ml of glycine buffer (pH 10.4). 100 µl of pNPP substrate in glycine buffer is added to each test well. Standard wells in triplicate are prepared from the working dilution of the ExtrAvidin-Alkaline Phosphotase in glycine buffer: 1:5,000 $(10^0)>10^{-0.5}>10^{-1}>10^{-1.5}$0.5 µl of each dilution is added to triplicate wells and the resulting AP content in each well is 5.50 ng, 1.74 ng, 0.55 ng, 0.18 ng. 100 µl of pNNP reagent must then be added to each of the standard wells. The plate must be incubated at 37° C. for 4 h. A volume of 50 µl of 3M NaOH is added to all wells. The results are quantified on a plate reader at 405 nm. The background subtraction option is used on blank wells filled with glycine buffer only. The template is set up to indicate the concentration of AP-conjugate in each standard well [5.50 ng; 1.74 ng; 0.55 ng; 0.18 ng]. Results are indicated as amount of bound AP-conjugate in each sample.

Example 24

Construction of GAS Reporter Construct

One signal transduction pathway involved in the differentiation and proliferation of cells is called the Jaks-STATs pathway. Activated proteins in the Jaks-STATs pathway bind to gamma activation site "GAS" elements or interferon-sensitive responsive element ("ISRE"), located in the promoter of many genes. The binding of a protein to these elements alter the expression of the associated gene.

GAS and ISRE elements are recognized by a class of transcription factors called Signal Transducers and Activators of Transcription, or "STATs." There are six members of the STATs family. Stat1 and Stat3 are present in many cell types, as is Stat2 (as response to IFN-alpha is widespread). Stat4 is more restricted and is not in many cell types though it has been found in T helper class I, cells after treatment with IL-12. Stat5 was originally called mammary growth factor, but has been found at higher concentrations in other cells including myeloid cells. It can be activated in tissue culture cells by many cytokines.

The STATs are activated to translocate from the cytoplasm to the nucleus upon tyrosine phosphorylation by a set of kinases known as the Janus Kinase ("Jaks") family. Jaks represent a distinct family of soluble tyrosine kinases and include Tyk2, Jak1, Jak2, and Jak3. These kinases display significant sequence similarity and are generally catalytically inactive in resting cells.

The Jaks are activated by a wide range of receptors summarized in the Table below. (Adapted from review by Schidler and Damell, Ann. Rev. Biochem. 64:621-51 (1995)). A cytokine receptor family, capable of activating Jaks, is divided into two groups: (a) Class 1 includes receptors for IL-2, IL-3, IL-4, IL-6, IL-7, IL-9, IL-11, IL-12, IL-15, Epo, PRL, GH, G-CSF, GM-CSF, LIF, CNTF, and thrombopoietin; and (b) Class 2 includes IFN-α, IFN-g, and IL-10. The Class 1 receptors share a conserved cysteine motif (a set of four conserved cysteines and one tryptophan) and a WSXWS motif (a membrane proximal region encoding Trp-Ser-Xaa-Trp-Ser (SEQ ID NO:53)).

Thus, on binding of a ligand to a receptor, Jaks are activated, which in turn activate STATs, which then translocate and bind to GAS elements. This entire process is encompassed in the Jaks-STATs signal transduction pathway. Therefore, activation of the Jaks-STATs pathway, reflected by the binding of the GAS or the ISRE element, can be used to indicate proteins involved in the proliferation and differentiation of cells. For example, growth factors and cytokines are known to activate the Jaks-STATs pathway (See Table 5, below). Thus, by using GAS elements linked to reporter molecules, activators of the Jaks-STATs pathway can be identified.

TABLE 5

| Ligand | JAKs tyk2 | Jak1 | Jak2 | Jak3 | STATS | GAS (elements) or ISRE |
|---|---|---|---|---|---|---|
| IFN family | | | | | | |
| IFN-a/B | + | + | − | − | 1, 2, 3 | ISRE |
| IFN-g | | + | + | − | 1 | GAS (IRF1 > Lys6 > IFP) |
| Il-10 | + | ? | ? | − | 1, 3 | |
| gp130 family | | | | | | |
| IL-6 (Pleiotropic) | + | + | + | ? | 1, 3 | GAS( IRF1 > Lys6 > IFP) |
| Il-11 (Pleiotropic) | ? | + | ? | ? | 1, 3 | |
| OnM (Pleiotropic) | ? | + | + | ? | 1, 3 | |
| LIF (Pleiotropic) | ? | + | + | ? | 1, 3 | |
| CNTF (Pleiotropic) | | −/+ | + | + | ? | 1, 3 |
| G-CSF (Pleiotropic) | | ? | + | ? | ? | 1, 3 |
| IL-12 (Pleiotropic) | | + | − | + | + | 1, 3 |
| g-C family | | | | | | |
| IL-2 (lymphocytes) | − | + | − | + | 1, 3, 5 | GAS |
| IL-4 (lymph/myeloid) | − | + | − | + | 6 | GAS (IRF1 = IFP >> Ly6)(IgH) |
| IL-7 (lymphocytes) | − | + | − | + | 5 | GAS |
| IL-9 (lymphocytes) | − | + | − | + | 5 | GAS |
| IL-13 (lymphocyte) | − | + | ? | ? | 6 | GAS |
| IL-15 | ? | + | ? | + | 5 | GAS |
| gp140 family | | | | | | |
| IL-3 (myeloid) | − | − | + | − | 5 | GAS(IRF1 > IFP >> Ly6) |
| IL-5 (myeloid) | − | − | + | − | 5 | GAS |
| GM-CSF (myeloid) | − | − | + | − | 5 | GAS |
| Growth hormone family | | | | | | |
| GH | ? | − | + | − | 5 | |
| PRL | ? | +/− | + | − | 1, 3, 5 | |
| EPO | ? | − | + | − | 5 | GAS (B-CAS > IRF1 = IFP >> Ly6) |
| Receptor Tyrosine Kinases | | | | | | |
| EGF | ? | + | + | − | 1, 3 | GAS (IRF1) |
| PDGF | ? | + | + | − | 1, 3 | |
| CSF-1 | ? | + | + | − | 1, 3 | GAS(not IRF1) |

To construct a synthetic GAS containing promoter element, which is used in the Biological Assays described in Examples 27-29, a PCR based strategy is employed to generate a GAS-SV40 promoter sequence. The 5' primer contains four tandem copies of the GAS binding site found in the IRF1 promoter and previously demonstrated to bind STATs upon induction with a range of cytokines (Rothman et al., Immunity 1:457-468 (1994).), although other GAS or ISRE elements can be used instead. The 5' primer also contains 18 bp of sequence complementary to the SV40 early promoter sequence and is flanked with an XhoI site. The sequence of the 5' primer is:

(SEQ ID NO: 54)
5':GCGCCTCGAGATTTCCCCGAAATCTAGATTTCCCCGAAATGATTTCC
CCGAAATGATTTCCCCGAAATATCTGCCATCTCAATTAG:3'

The downstream primer is complementary to the SV40 promoter and is flanked with a Hind III site:

5':GCGGCAAGCTTTTTGCAAAGCCTAGGC:3' (SEQ ID NO: 55)

PCR amplification is performed using the SV40 promoter template present in the B-gal:promoter plasmid obtained from Clontech. The resulting PCR fragment is digested with XhoI/Hind III and subcloned into BLSK2−. (Stratagene.) Sequencing with forward and reverse primers confirms that the insert contains the following sequence:

(SEQ ID NO: 56)
5':CTCGAGATTTCCCCGAAATCTAGATTTCCCCGAAATGATTTCCCCGA
AATGATTTCCCCGAAATATCTGCCATCTCAATTAGTCAGCAACCATAGTC
CCGCCCCTAACTCCGCCCATCCCGCCCCTAACTCCGCCCAGTTCCGCCCA
TTCTCCGCCCCATGGCTGACTAATTTTTTTTATTTATGCAGAGGCCGAGG
CCGCCTCGGCCTCTGAGCTATTCCAGAAGTAGTGAGGAGGCTTTTTTGGA
GGCCTAGGCTTTTGCAAAAAGCTT:3'

With this GAS promoter element linked to the SV40 promoter, a GAS:SEAP2 reporter construct is next engineered. Here, the reporter molecule is a secreted alkaline phosphatase, or "SEAP." Clearly, however, any reporter molecule can be instead of SEAP, in this or in any of the other Examples. Well known reporter molecules that can be used instead of SEAP include chloramphenicol acetyltransferase (CAT), luciferase, alkaline phosphatase, B-galactosidase, green fluorescent protein (GFP), or any protein detectable by an antibody.

The above sequence confirmed synthetic GAS-SV40 promoter element is subcloned into the pSEAP-Promoter vector obtained from Clontech using HindIII and XhoI, effectively replacing the SV40 promoter with the amplified GAS:SV40 promoter element, to create the GAS-SEAP vector. However, this vector does not contain a neomycin resistance gene, and therefore, is not preferred for mammalian expression systems.

Thus, in order to generate mammalian stable cell lines expressing the GAS-SEAP reporter, the GAS-SEAP cassette is removed from the GAS-SEAP vector using SalI and NotI, and inserted into a backbone vector containing the neomycin resistance gene, such as pGFP-1 (Clontech), using these restriction sites in the multiple cloning site, to create the GAS-SEAP/Neo vector. Once this vector is transfected into mammalian cells, this vector can then be used as a reporter molecule for GAS binding as described in Examples 27-29.

Other constructs can be made using the above description and replacing GAS with a different promoter sequence. For example, construction of reporter molecules containing EGR and NF-KB promoter sequences are described in Examples 27-31. However, many other promoters can be substituted using the protocols described in these Examples. For instance, SRE, IL-2, NFAT, or Osteocalcin promoters can be substituted, alone or in combination (e.g., GAS/NF-KB/EGR, GAS/NF-KB, Il-2/NFAT, or NF-KB/GAS). Similarly, other cell lines can be used to test reporter construct activity, such as HELA (epithelial), HUVEC (endothelial), Reh (B-cell), Saos-2 (osteoblast), HUVAC (aortic), or Cardiomyocyte.

Example 25

Assay for SEAP Activity

As a reporter molecule for the assays described in examples disclosed herein, SEAP activity is assayed using the Tropix Phospho-light Kit (Cat. BP-400) according to the following general procedure. The Tropix Phospho-light Kit supplies the Dilution, Assay, and Reaction Buffers used below.

Prime a dispenser with the 2.5× Dilution Buffer and dispense 15 ul of 2.5× dilution buffer into Optiplates containing 35 ul of a solution containing an albumin fusion protein of the invention. Seal the plates with a plastic sealer and incubate at 65 degree C. for 30 min. Separate the Optiplates to avoid uneven heating.

Cool the samples to room temperature for 15 minutes. Empty the dispenser and prime with the Assay Buffer. Add 50 ml Assay Buffer and incubate at room temperature 5 min. Empty the dispenser and prime with the Reaction Buffer (see the Table below). Add 50 ul Reaction Buffer and incubate at room temperature for 20 minutes. Since the intensity of the chemiluminescent signal is time dependent, and it takes about 10 minutes to read 5 plates on a luminometer, thus one should treat 5 plates at each time and start the second set 10 minutes later.

Read the relative light unit in the luminometer. Set H12 as blank, and print the results. An increase in chemiluminescence indicates reporter activity.

TABLE 6

| # of plates | Rxn buffer diluent (ml) | CSPD (ml) |
|---|---|---|
| 10 | 60 | 3 |
| 11 | 65 | 3.25 |
| 12 | 70 | 3.5 |
| 13 | 75 | 3.75 |
| 14 | 80 | 4 |
| 15 | 85 | 4.25 |
| 16 | 90 | 4.5 |
| 17 | 95 | 4.75 |
| 18 | 100 | 5 |
| 19 | 105 | 5.25 |
| 20 | 110 | 5.5 |

TABLE 6-continued

| # of plates | Rxn buffer diluent (ml) | CSPD (ml) |
|---|---|---|
| 21 | 115 | 5.75 |
| 22 | 120 | 6 |
| 23 | 125 | 6.25 |
| 24 | 130 | 6.5 |
| 25 | 135 | 6.75 |
| 26 | 140 | 7 |
| 27 | 145 | 7.25 |
| 28 | 150 | 7.5 |
| 29 | 155 | 7.75 |
| 30 | 160 | 8 |
| 31 | 165 | 8.25 |
| 32 | 170 | 8.5 |
| 33 | 175 | 8.75 |
| 34 | 180 | 9 |
| 35 | 185 | 9.25 |
| 36 | 190 | 9.5 |
| 37 | 195 | 9.75 |
| 38 | 200 | 10 |
| 39 | 205 | 10.25 |
| 40 | 210 | 10.5 |
| 41 | 215 | 10.75 |
| 42 | 220 | 11 |
| 43 | 225 | 11.25 |
| 44 | 230 | 11.5 |
| 45 | 235 | 11.75 |
| 46 | 240 | 12 |
| 47 | 245 | 12.25 |
| 48 | 250 | 12.5 |
| 49 | 255 | 12.75 |
| 50 | 260 | 13 |

Example 26

Assay Identifying Neuronal Activity

When cells undergo differentiation and proliferation, a group of genes are activated through many different signal transduction pathways. One of these genes, EGR1 (early growth response gene 1), is induced in various tissues and cell types upon activation. The promoter of EGR1 is responsible for such induction. Using the EGR1 promoter linked to reporter molecules, the ability of fusion proteins of the invention to activate cells can be assessed.

Particularly, the following protocol is used to assess neuronal activity in PC12 cell lines. PC12 cells (rat phenochromocytoma cells) are known to proliferate and/or differentiate by activation with a number of mitogens, such as TPA (tetradecanoyl phorbol acetate), NGF (nerve growth factor), and EGF (epidermal growth factor). The EGR1 gene expression is activated during this treatment. Thus, by stably transfecting PC12 cells with a construct containing an EGR promoter linked to SEAP reporter, activation of PC12 cells by an albumin fusion protein of the present invention can be assessed.

The EGR/SEAP reporter construct can be assembled by the following protocol. The EGR-1 promoter sequence (−633 to +1)(Sakamoto K et al., Oncogene 6:867-871 (1991)) can be PCR amplified from human genomic DNA using the following primers:

```
First primer:
                                      (SEQ ID NO: 57)
5' GCGCTCGAGGGATGACAGCGATAGAACCCCGG-3'

Second primer:
                                      (SEQ ID NO: 58)
5' GCGAAGCTTCGCGACTCCCCGGATCCGCCTC-3'
```

Using the GAS:SEAP/Neo vector produced in Example 24, EGR1 amplified product can then be inserted into this vector. Linearize the GAS:SEAP/Neo vector using restriction enzymes XhoI/HindIII, removing the GAS/SV40 stuffer. Restrict the EGR1 amplified product with these same enzymes. Ligate the vector and the EGR1 promoter.

To prepare 96 well-plates for cell culture, two mls of a coating solution (1:30 dilution of collagen type I (Upstate Biotech Inc. Cat#08-115) in 30% ethanol (filter sterilized)) is added per one 10 cm plate or 50 ml per well of the 96-well plate, and allowed to air dry for 2 hr.

PC12 cells are routinely grown in RPMI-1640 medium (Bio Whittaker) containing 10% horse serum (JRH BIOSCIENCES, Cat. #12449-78P), 5% heat-inactivated fetal bovine serum (FBS) supplemented with 100 units/ml penicillin and 100 ug/ml streptomycin on a precoated 10 cm tissue culture dish. One to four split is done every three to four days. Cells are removed from the plates by scraping and resuspended with pipetting up and down for more than 15 times.

Transfect the EGR/SEAP/Neo construct into PC12 using techniques known in the art. EGR-SEAP/PC12 stable cells are obtained by growing the cells in 300 ug/ml G418. The G418-free medium is used for routine growth but every one to two months, the cells should be re-grown in 300 ug/ml G418 for couple of passages.

To assay for neuronal activity, a 10 cm plate with cells around 70 to 80% confluent is screened by removing the old medium. Wash the cells once with PBS (Phosphate buffered saline). Then starve the cells in low serum medium (RPMI-1640 containing 1% horse serum and 0.5% FBS with antibiotics) overnight.

The next morning, remove the medium and wash the cells with PBS. Scrape off the cells from the plate, suspend the cells well in 2 ml low serum medium. Count the cell number and add more low serum medium to reach final cell density as $5\times10^5$ cells/ml.

Add 200 ul of the cell suspension to each well of 96-well plate (equivalent to $1\times10^5$ cells/well). Add a series of different concentrations of an albumin fusion protein of the invention, 37 degree C. for 48 to 72 hr. As a positive control, a growth factor known to activate PC12 cells through EGR can be used, such as 50 ng/ul of Neuronal Growth Factor (NGF). Over fifty-fold induction of SEAP is typically seen in the positive control wells. SEAP assay may be routinely performed using techniques known in the art and/or as described in Example 25.

Example 27

Assay for T-Cell Activity

The following protocol is used to assess T-cell activity by identifying factors, and determining whether an albumin fusion protein of the invention proliferates and/or differentiates T-cells. T-cell activity is assessed using the GAS/SEAP/Neo construct produced in Example 24. Thus, factors that increase SEAP activity indicate the ability to activate the Jaks-STATS signal transduction pathway. The T-cell used in this assay is Jurkat T-cells (ATCC™ Accession No. TIB-152), although Molt-3 cells (ATCC™ Accession No. CRL-1552) and Molt-4 cells (ATCC™ Accession No. CRL-1582) cells can also be used.

Jurkat T-cells are lymphoblastic CD4+ Th1 helper cells. In order to generate stable cell lines, approximately 2 million Jurkat cells are transfected with the GAS-SEAP/neo vector using DMRIE-C (Life Technologies)(transfection procedure described below). The transfected cells are seeded to a density of approximately 20,000 cells per well and transfectants resistant to 1 mg/ml genticin selected. Resistant colonies are expanded and then tested for their response to increasing concentrations of interferon gamma. The dose response of a selected clone is demonstrated.

Specifically, the following protocol will yield sufficient cells for 75 wells containing 200 ul of cells. Thus, it is either scaled up, or performed in multiple to generate sufficient cells for multiple 96 well plates. Jurkat cells are maintained in RPMI+10% serum with 1% Pen-Strep. Combine 2.5 mls of OPTI-MEM (Life Technologies) with 10 ug of plasmid DNA in a T25 flask. Add 2.5 ml OPTI-MEM containing 50 ul of DMRIE-C and incubate at room temperature for 15-45 mins.

During the incubation period, count cell concentration, spin down the required number of cells ($10^7$ per transfection), and resuspend in OPTI-MEM to a final concentration of $10^7$ cells/ml. Then add 1 ml of $1\times10^7$ cells in OPTI-MEM to T25 flask and incubate at 37 degree C. for 6 hrs. After the incubation, add 10 ml of RPMI+15% serum.

The Jurkat:GAS-SEAP stable reporter lines are maintained in RPMI+10% serum, 1 mg/ml Genticin, and 1% Pen-Strep. These cells are treated with varying concentrations of one or more fusion proteins of the present invention.

On the day of treatment with the fusion protein, the cells should be washed and resuspended in fresh RPMI+10% serum to a density of 500,000 cells per ml. The exact number of cells required will depend on the number of fusion proteins and the number of different concentrations of fusion proteins being screened. For one 96 well plate, approximately 10 million cells (for 10 plates, 100 million cells) are required.

The well dishes containing Jurkat cells treated with the fusion protein are placed in an incubator for 48 hrs (note: this time is variable between 48-72 hrs). 35 ul samples from each well are then transferred to an opaque 96 well plate using a 12 channel pipette. The opaque plates should be covered (using sellophene covers) and stored at −20 degree C. until SEAP assays are performed according to Example 25. The plates containing the remaining treated cells are placed at 4 degree C. and serve as a source of material for repeating the assay on a specific well if desired.

As a positive control, 100 Unit/ml interferon gamma can be used which is known to activate Jurkat T cells. Over 30 fold induction is typically observed in the positive control wells.

The above protocol may be used in the generation of both transient, as well as, stable transfected cells, which would be apparent to those of skill in the art.

Example 28

Assay for T-Cell Activity

NF-KB (Nuclear Factor KB) is a transcription factor activated by a wide variety of agents including the inflammatory cytokines IL-1 and TNF, CD30 and CD40, lymphotoxin-alpha and lymphotoxin-beta, by exposure to LPS or thrombin, and by expression of certain viral gene products. As a transcription factor, NF-KB regulates the expression of genes involved in immune cell activation, control of apoptosis (NF-KB appears to shield cells from apoptosis), B and T-cell development, anti-viral and antimicrobial responses, and multiple stress responses.

In non-stimulated conditions, NF-KB is retained in the cytoplasm with I-KB (Inhibitor KB). However, upon stimulation, I-KB is phosphorylated and degraded, causing NF-KB to shuttle to the nucleus, thereby activating transcription of target genes. Target genes activated by NF-KB include IL-2, IL-6, GM-CSF, ICAM-1 and class 1 MHC.

Due to its central role and ability to respond to a range of stimuli, reporter constructs utilizing the NF-KB promoter element are used to screen the fusion protein. Activators or inhibitors of NF-KB would be useful in treating, preventing, and/or diagnosing diseases. For example, inhibitors of NF-KB could be used to treat those diseases related to the acute or chronic activation of NF-KB, such as rheumatoid arthritis.

To construct a vector containing the NF-KB promoter element, a PCR based strategy is employed. The upstream primer contains four tandem copies of the NF-KB binding site (GGGGACTTTCCC) (SEQ ID NO:59), 18 bp of sequence complementary to the 5' end of the SV40 early promoter sequence, and is flanked with an XhoI site:

```
                                      (SEQ ID NO: 60)
5':GCGGCCTCGAGGGGACTTTCCCGGGGACTTTCCGGGGACTTTCCGGG

ACTTTCCATCCTGCCATCTCAATTAG:3'
```

The downstream primer is complementary to the 3' end of the SV40 promoter and is flanked with a Hind III site:

```
5':GCGGCAAGCTTTTTGCAAAGCCTAGGC:3'   (SEQ ID NO: 55)
```

PCR amplification is performed using the SV40 promoter template present in the pB-gal:promoter plasmid obtained from Clontech. The resulting PCR fragment is digested with XhoI and Hind III and subcloned into BLSK2−. (Stratagene) Sequencing with the T7 and T3 primers confirms the insert contains the following sequence:

```
                                      (SEQ ID NO: 61)
5':CTCGAGGGGACTTTCCCGGGGACTTTCCGGGGACTTTCCGGGACTTT

CCATCTGCCATCTCAATTAGTCAGCAACCATAGTCCCGCCCCTAACTCCG

CCCATCCCGCCCCTAACTCCGCCCAGTTCCGCCCATTCTCCGCCCCATGG

CTGACTAATTTTTTTTATTTATGCAGAGGCCGAGGCCGCCTCGGCCTCTG

AGCTATTCCAGAAGTAGTGAGGAGGCTTTTTTGGAGGCCTAGGCTTTTGC

AAAAAGCTT:3'
```

Next, replace the SV40 minimal promoter element present in the pSEAP2-promoter plasmid (Clontech) with this NF-KB/SV40 fragment using XhoI and HindIII. However, this vector does not contain a neomycin resistance gene, and therefore, is not preferred for mammalian expression systems.

In order to generate stable mammalian cell lines, the NF-KB/SV40/SEAP cassette is removed from the above NF-KB/SEAP vector using restriction enzymes SalI and NotI, and inserted into a vector containing neomycin resistance. Particularly, the NF-KB/SV40/SEAP cassette was inserted into pGFP-1 (Clontech), replacing the GFP gene, after restricting pGFP-1 with SalI and NotI.

Once NF-KB/SV40/SEAP/Neo vector is created, stable Jurkat T-cells are created and maintained according to the protocol described in Example 25. Similarly, the method for assaying fusion proteins with these stable Jurkat T-cells is also described in Example 25. As a positive control, exogenous TNF alpha (0.1, 1, 10 ng) is added to wells H9, H10, and $H_{11}$, with a 5-10 fold activation typically observed.

Example 29

Assay Identifying Myeloid Activity

The following protocol is used to assess myeloid activity of an albumin fusion protein of the present invention by determining whether the fusion protein proliferates and/or differentiates myeloid cells. Myeloid cell activity is assessed using the GAS/SEAP/Neo construct produced in Example 24. Thus, factors that increase SEAP activity indicate the ability to activate the Jaks-STATS signal transduction pathway. The myeloid cell used in this assay is U937, a pre-monocyte cell line, although TF-1, HL60, or KG1 can be used.

To transiently transfect U937 cells with the GAS/SEAP/Neo construct produced in Example 24, a DEAE-Dextran method (Kharbanda et. al., 1994, Cell Growth & Differentiation, 5:259-265) is used. First, harvest $2\times10^7$ U937 cells and wash with PBS. The U937 cells are usually grown in RPMI 1640 medium containing 10% heat-inactivated fetal bovine serum (FBS) supplemented with 100 units/ml penicillin and 100 mg/ml streptomycin.

Next, suspend the cells in 1 ml of 20 mM Tris-HCl (pH 7.4) buffer containing 0.5 mg/ml DEAE-Dextran, 8 ug GAS-SEAP2 plasmid DNA, 140 mM NaCl, 5 mM KCl, 375 uM $Na_2HPO_4.7H_2O$, 1 mM $MgCl_2$, and 675 uM $CaCl_2$. Incubate at 37 degrees C. for 45 min.

Wash the cells with RPMI 1640 medium containing 10% FBS and then resuspend in 10 ml complete medium and incubate at 37 degree C. for 36 hr.

The GAS-SEAP/U937 stable cells are obtained by growing the cells in 400 ug/ml G418. The G418-free medium is used for routine growth but every one to two months, the cells should be re-grown in 400 ug/ml G418 for couple of passages.

These cells are tested by harvesting $1\times10^8$ cells (this is enough for ten 96-well plates assay) and wash with PBS. Suspend the cells in 200 ml above described growth medium, with a final density of $5\times10^5$ cells/ml. Plate 200 ul cells per well in the 96-well plate (or $1\times10^5$ cells/well).

Add different concentrations of the fusion protein. Incubate at 37 degree C. for 48 to 72 hr. As a positive control, 100 Unit/ml interferon gamma can be used which is known to activate U937 cells. Over 30 fold induction is typically observed in the positive control wells. SEAP assay the supernatant according to methods known in the art and/or the protocol described in Example 25.

Example 30

Assay Identifying Changes in Small Molecule Concentration and Membrane Permeability Binding of a ligand to a receptor is known to alter intracellular levels of small molecules, such as calcium, potassium, sodium, and pH, as well as alter membrane potential. These alterations can be measured in an assay to identify fusion proteins which bind to receptors of a particular cell. Although the following protocol describes an assay for calcium, this protocol can easily be modified to detect changes in potassium, sodium, pH, membrane potential, or any other small molecule which is detectable by a fluorescent probe.

The following assay uses Fluorometric Imaging Plate Reader ("FLIPR") to measure changes in fluorescent molecules (Molecular Probes) that bind small molecules. Clearly, any fluorescent molecule detecting a small molecule can be used instead of the calcium fluorescent molecule, fluo-4 (Molecular Probes, Inc.; catalog no. F-14202), used here.

For adherent cells, seed the cells at 10,000-20,000 cells/well in a Co-star black 96-well plate with clear bottom. The plate is incubated in a $CO_2$ incubator for 20 hours. The adherent cells are washed two times in Biotek washer with 200 ul of HBSS (Hank's Balanced Salt Solution) leaving 100 ul of buffer after the final wash.

A stock solution of 1 mg/ml fluo-4 is made in 10% pluronic acid DMSO. To load the cells with fluo-4, 50 ul of 12 ug/ml fluo-4 is added to each well. The plate is incubated at 37 degrees C. in a $CO_2$ incubator for 60 min. The plate is washed four times in the Biotek washer with HBSS leaving 100 ul of buffer.

For non-adherent cells, the cells are spun down from culture media. Cells are re-suspended to 2-5×$10^6$ cells/ml with HBSS in a 50-ml conical tube. 4 ul of 1 mg/ml fluo-4 solution in 10% pluronic acid DMSO is added to each ml of cell suspension. The tube is then placed in a 37 degrees C. water bath for 30-60 min. The cells are washed twice with HBSS, resuspended to 1×$10^6$ cells/ml, and dispensed into a microplate, 100 ul/well. The plate is centrifuged at 1000 rpm for 5 min. The plate is then washed once in Denley Cell Wash with 200 ul, followed by an aspiration step to 100 ul final volume.

For a non-cell based assay, each well contains a fluorescent molecule, such as fluo-4. The fusion protein of the invention is added to the well, and a change in fluorescence is detected.

To measure the fluorescence of intracellular calcium, the FLIPR is set for the following parameters: (1) System gain is 300-800 mW; (2) Exposure time is 0.4 second; (3) Camera F/stop is F/2; (4) Excitation is 488 nm; (5) Emission is 530 nm; and (6) Sample addition is 50 ul. Increased emission at 530 nm indicates an extracellular signaling event caused by an albumin fusion protein of the present invention or a molecule induced by an albumin fusion protein of the present invention, which has resulted in an increase in the intracellular $Ca^{++}$ concentration.

Example 31

Assay Identifying Tyrosine Kinase Activity

The Protein Tyrosine Kinases (PTK) represent a diverse group of transmembrane and cytoplasmic kinases. Within the Receptor Protein Tyrosine Kinase (RPTK) group are receptors for a range of mitogenic and metabolic growth factors including the PDGF, FGF, EGF, NGF, HGF and Insulin receptor subfamilies. In addition there are a large family of RPTKs for which the corresponding ligand is unknown. Ligands for RPTKs include mainly secreted small proteins, but also membrane-bound and extracellular matrix proteins.

Activation of RPTK by ligands involves ligand-mediated receptor dimerization, resulting in transphosphorylation of the receptor subunits and activation of the cytoplasmic tyrosine kinases. The cytoplasmic tyrosine kinases include receptor associated tyrosine kinases of the src-family (e.g., src, yes, lck, lyn, fyn) and non-receptor linked and cytosolic protein tyrosine kinases, such as the Jak family, members of which mediate signal transduction triggered by the cytokine superfamily of receptors (e.g., the Interleukins, Interferons, GM-CSF, and Leptin).

Because of the wide range of known factors capable of stimulating tyrosine kinase activity, identifying whether an albumin fusion protein of the present invention or a molecule induced by a fusion protein of the present invention is capable of activating tyrosine kinase signal transduction pathways is of interest. Therefore, the following protocol is designed to identify such molecules capable of activating the tyrosine kinase signal transduction pathways.

Seed target cells (e.g., primary keratinocytes) at a density of approximately 25,000 cells per well in a 96 well Loprodyne Silent Screen Plates purchased from Nalge Nunc (Naperville, Ill.). The plates are sterilized with two 30 minute rinses with 100% ethanol, rinsed with water and dried overnight. Some plates are coated for 2 hr with 100 ml of cell culture grade type I collagen (50 mg/ml), gelatin (2%) or polylysine (50 mg/ml), all of which can be purchased from Sigma Chemicals (St. Louis, Mo.) or 10% Matrigel purchased from Becton Dickinson (Bedford, Mass.), or calf serum, rinsed with PBS and stored at 4 degree C. Cell growth on these plates is assayed by seeding 5,000 cells/well in growth medium and indirect quantitation of cell number through use of alamarBlue as described by the manufacturer Alamar Biosciences, Inc. (Sacramento, Calif.) after 48 hr. Falcon plate covers #3071 from Becton Dickinson (Bedford, Mass.) are used to cover the Loprodyne Silent Screen Plates. Falcon Microtest III cell culture plates can also be used in some proliferation experiments.

To prepare extracts, A431 cells are seeded onto the nylon membranes of Loprodyne plates (20,000/200 ml/well) and cultured overnight in complete medium. Cells are quiesced by incubation in serum-free basal medium for 24 hr. After 5-20 minutes treatment with EGF (60 ng/ml) or a different concentrations of an albumin fusion protein of the invention, the medium was removed and 100 ml of extraction buffer ((20 mM HEPES pH 7.5, 0.15 M NaCl, 1% Triton X-100, 0.1% SDS, 2 mM Na3VO4, 2 mM Na4P2O7 and a cocktail of protease inhibitors (#1836170) obtained from Boehereinger Mannheim (Indianapolis, Ind.)) is added to each well and the plate is shaken on a rotating shaker for 5 minutes at 4° C. The plate is then placed in a vacuum transfer manifold and the extract filtered through the 0.45 mm membrane bottoms of each well using house vacuum. Extracts are collected in a 96-well catch/assay plate in the bottom of the vacuum manifold and immediately placed on ice. To obtain extracts clarified by centrifugation, the content of each well, after detergent solubilization for 5 minutes, is removed and centrifuged for 15 minutes at 4 degree C. at 16,000×g.

Test the filtered extracts for levels of tyrosine kinase activity. Although many methods of detecting tyrosine kinase activity are known, one method is described here.

Generally, the tyrosine kinase activity of an albumin fusion protein of the invention is evaluated by determining its ability to phosphorylate a tyrosine residue on a specific substrate (a biotinylated peptide). Biotinylated peptides that can be used for this purpose include PSK1 (corresponding to amino acids 6-20 of the cell division kinase cdc2-p34) and PSK2 (corresponding to amino acids 1-17 of gastrin). Both peptides are substrates for a range of tyrosine kinases and are available from Boehringer Mannheim.

The tyrosine kinase reaction is set up by adding the following components in order. First, add 10 ul of 5 uM Biotinylated Peptide, then 10 ul ATP/$Mg_{2+}$ (5 mM ATP/50 mM $MgCl_2$), then 10 ul of 5× Assay Buffer (40 mM imidazole hydrochloride, pH7.3, 40 mM beta-glycerophosphate, 1 mM EGTA, 100 mM $MgCl_2$, 5 mM $MnCl_2$, 0.5 mg/ml BSA), then 5 ul of Sodium Vanadate (1 mM), and then 5 ul of water. Mix the components gently and preincubate the reaction mix at 30 degree C. for 2 min. Initial the reaction by adding 10 ul of the control enzyme or the filtered supernatant.

The tyrosine kinase assay reaction is then terminated by adding 10 ul of 120 mm EDTA and place the reactions on ice.

Tyrosine kinase activity is determined by transferring 50 ul aliquot of reaction mixture to a microtiter plate (MTP) module and incubating at 37 degree C. for 20 min. This allows the streptavidin coated 96 well plate to associate with the biotinylated peptide. Wash the MTP module with 300 ul/well of PBS four times. Next add 75 ul of anti-phosphotyrosine antibody conjugated to horse radish peroxidase(anti-P-Tyr-POD (0.5 u/ml)) to each well and incubate at 37 degree C. for one hour. Wash the well as above.

Next add 100 ul of peroxidase substrate solution (Boehringer Mannheim) and incubate at room temperature for at least 5 mins (up to 30 min). Measure the absorbance of the sample at 405 nm by using ELISA reader. The level of bound peroxidase activity is quantitated using an ELISA reader and reflects the level of tyrosine kinase activity.

Example 32

Assay Identifying Phosphorylation Activity

As a potential alternative and/or complement to the assay of protein tyrosine kinase activity described in Example 31, an assay which detects activation (phosphorylation) of major intracellular signal transduction intermediates can also be used. For example, as described below one particular assay can detect tyrosine phosphorylation of the Erk-1 and Erk-2 kinases. However, phosphorylation of other molecules, such as Raf, JNK, p38 MAP, Map kinase kinase (MEK), MEK kinase, Src, Muscle specific kinase (MuSK), IRAK, Tec, and Janus, as well as any other phosphoserine, phosphotyrosine, or phosphothreonine molecule, can be detected by substituting these molecules for Erk-1 or Erk-2 in the following assay.

Specifically, assay plates are made by coating the wells of a 96-well ELISA plate with 0.1 ml of protein G (1 ug/ml) for 2 hr at room temp, (RT). The plates are then rinsed with PBS and blocked with 3% BSA/PBS for 1 hr at RT. The protein G plates are then treated with 2 commercial monoclonal antibodies (100 ng/well) against Erk-1 and Erk-2 (1 hr at RT) (Santa Cruz Biotechnology). (To detect other molecules, this step can easily be modified by substituting a monoclonal antibody detecting any of the above described molecules.) After 3-5 rinses with PBS, the plates are stored at 4 degree C. until use.

A431 cells are seeded at 20,000/well in a 96-well Loprodyne filterplate and cultured overnight in growth medium. The cells are then starved for 48 hr in basal medium (DMEM) and then treated with EGF (6 ng/well) or varying concentrations of the fusion protein of the invention for 5-20 minutes. The cells are then solubilized and extracts filtered directly into the assay plate.

After incubation with the extract for 1 hr at RT, the wells are again rinsed. As a positive control, a commercial preparation of MAP kinase (10 ng/well) is used in place of A431 extract. Plates are then treated with a commercial polyclonal (rabbit) antibody (1 ug/ml) which specifically recognizes the phosphorylated epitope of the Erk-1 and Erk-2 kinases (1 hr at RT). This antibody is biotinylated by standard procedures. The bound polyclonal antibody is then quantitated by successive incubations with Europium-streptavidin and Europium fluorescence enhancing reagent in the Wallac DELFIA instrument (time-resolved fluorescence). An increased fluorescent signal over background indicates a phosphorylation by the fusion protein of the present invention or a molecule induced by an albumin fusion protein of the present invention.

Example 33

Phosphorylation Assay

In order to assay for phosphorylation activity of an albumin fusion protein of the invention, a phosphorylation assay as described in U.S. Pat. No. 5,958,405 (which is herein incorporated by reference) is utilized. Briefly, phosphorylation activity may be measured by phosphorylation of a protein substrate using gamma-labeled $^{32}$P-ATP and quantitation of the incorporated radioactivity using a gamma radioisotope counter. The fusion protein of the invention is incubated with the protein substrate, $^{32}$P-ATP, and a kinase buffer. The $^{32}$P incorporated into the substrate is then separated from free $^{32}$P-ATP by electrophoresis, and the incorporated $^{32}$P is counted and compared to a negative control. Radioactivity counts above the negative control are indicative of phosphorylation activity of the fusion protein.

Example 34

Detection of Phosphorylation Activity (Activation) of an Albumin Fusion Protein of the Invention in the Presence of Polypeptide Ligands Methods known in the art or described herein may be used to determine the phosphorylation activity of an albumin fusion protein of the invention. A preferred method of determining phosphorylation activity is by the use of the tyrosine phosphorylation assay as described in U.S. Pat. No. 5,817,471 (incorporated herein by reference).

Example 35

Assay for the Stimulation of Bone Marrow CD34+ Cell Proliferation

This assay is based on the ability of human CD34+ to proliferate in the presence of hematopoietic growth factors and evaluates the ability of fusion proteins of the invention to stimulate proliferation of CD34+ cells.

It has been previously shown that most mature precursors will respond to only a single signal. More immature precursors require at least two signals to respond. Therefore, to test the effect of fusion proteins of the invention on hematopoietic activity of a wide range of progenitor cells, the assay contains a given fusion protein of the invention in the presence or absence of hematopoietic growth factors. Isolated cells are cultured for 5 days in the presence of Stem Cell Factor (SCF) in combination with tested sample. SCF alone has a very limited effect on the proliferation of bone marrow (BM) cells, acting in such conditions only as a "survival" factor. However, combined with any factor exhibiting stimulatory effect on these cells (e.g., IL-3), SCF will cause a synergistic effect. Therefore, if the tested fusion protein has a stimulatory effect on hematopoietic progenitors, such activity can be easily detected. Since normal BM cells have a low level of cycling cells, it is likely that any inhibitory effect of a given fusion protein might not be detected. Accordingly, assays for an inhibitory effect on progenitors is preferably tested in cells that are first subjected to in vitro stimulation with SCF+IL+3, and then contacted with the compound that is being evaluated for inhibition of such induced proliferation.

Briefly, CD34+ cells are isolated using methods known in the art. The cells are thawed and resuspended in medium (QBSF 60 serum-free medium with 1% L-glutamine (500 ml) Quality Biological, Inc., Gaithersburg, Md. Cat#160-204-101). After several gentle centrifugation steps at 200×g, cells are allowed to rest for one hour. The cell count is adjusted to $2.5\times10^5$ cells/ml. During this time, 100 μl of sterile water is added to the peripheral wells of a 96-well plate. The cytokines that can be tested with an albumin fusion protein of the invention in this assay is rhSCF (R&D Systems, Minneapolis, Minn., Cat#255-SC) at 50 ng/ml alone and in combination with rhSCF and rhIL-3 (R&D Systems, Minneapolis, Minn., Cat#203-ML) at 30 ng/ml. After one hour, 10 μl of prepared cytokines, varying concentrations of an albumin fusion protein of the invention, and 20 μl of diluted cells are added to the media which is already present in the wells to allow for a final total volume of 100 μl. The plates are then placed in a 37° C./5% $CO_2$ incubator for five days.

Eighteen hours before the assay is harvested, 0.5 μCi/well of [3H] Thymidine is added in a 10 μl volume to each well to determine the proliferation rate. The experiment is terminated by harvesting the cells from each 96-well plate to a filtermat using the Tomtec Harvester 96. After harvesting, the filtermats are dried, trimmed and placed into OmniFilter assemblies consisting of one OmniFilter plate and one OmniFilter Tray. 60 μl Microscint is added to each well and the plate sealed with TopSeal-A press-on sealing film A bar code 15 sticker is affixed to the first plate for counting. The sealed plates are then loaded and the level of radioactivity determined via the Packard Top Count and the printed data collected for analysis. The level of radioactivity reflects the amount of cell proliferation.

The studies described in this example test the activity of a given fusion protein to stimulate bone marrow CD34+ cell proliferation. One skilled in the art could easily modify the exemplified studies to test the activity of fusion proteins and polynucleotides of the invention (e.g., gene therapy) as well as agonists and antagonists thereof. The ability of an albumin fusion protein of the invention to stimulate the proliferation of bone marrow CD34+ cells indicates that the albumin fusion protein and/or polynucleotides corresponding to the fusion protein are useful for the diagnosis and treatment of disorders affecting the immune system and hematopoiesis. Representative uses are described in the "Immune Activity" and "Infectious Disease" sections above, and elsewhere herein.

Example 36

Assay for Extracellular Matrix Enhanced Cell Response (EMECR)

The objective of the Extracellular Matrix Enhanced Cell Response (EMECR) assay is to evaluate the ability of fusion proteins of the invention to act on hematopoietic stem cells in the context of the extracellular matrix (ECM) induced signal.

Cells respond to the regulatory factors in the context of signal(s) received from the surrounding microenvironment. For example, fibroblasts, and endothelial and epithelial stem cells fail to replicate in the absence of signals from the ECM. Hematopoietic stem cells can undergo self-renewal in the bone marrow, but not in in vitro suspension culture. The ability of stem cells to undergo self-renewal in vitro is dependent upon their interaction with the stromal cells and the ECM protein fibronectin (fn). Adhesion of cells to fn is mediated by the $\alpha_5.\beta_1$ and $\alpha_4.\beta_1$ integrin receptors, which are expressed by human and mouse hematopoietic stem cells. The factor(s) which integrate with the ECM environment and are responsible for stimulating stem cell self-renewal have a not yet been identified. Discovery of such factors should be of great interest in gene therapy and bone marrow transplant applications Briefly, polystyrene, non tissue culture treated, 96-well plates are coated with fn fragment at a coating concentration of 0.2 μg/cm$^2$. Mouse bone marrow cells are plated (1,000 cells/well) in 0.2 ml of serum-free medium. Cells cultured in the presence of IL-3 (5 ng/ml)+SCF (50 ng/ml) would serve as the positive control, conditions under which little self-renewal but pronounced differentiation of the stem cells is to be expected. Albumin fusion proteins of the invention are tested with appropriate negative controls in the presence and absence of SCF (5.0 ng/ml), where volume of the administed composition containing the albumin fusion protein of the invention represents 10% of the total assay volume. The plated cells are then allowed to grow by incubating in a low oxygen environment (5% $CO_2$, 7% $O_2$, and 88% $N_2$) tissue culture incubator for 7 days. The number of proliferating cells within the wells is then quantitated by measuring thymidine incorporation into cellular DNA. Verification of the positive hits in the assay will require phenotypic characterization of the cells, which can be accomplished by scaling up of the culture system and using appropriate antibody reagents against cell surface antigens and FACScan.

If a particular fusion protein of the present invention is found to be a stimulator of hematopoietic progenitors, the fusion protein and polynucleotides corresponding to the fusion protein may be useful for example, in the diagnosis and treatment of disorders affecting the immune system and hematopoiesis. Representative uses are described in the "Immune Activity" and "Infectious Disease" sections above, and elsewhere herein. The fusion protein may also be useful in the expansion of stem cells and committed progenitors of various blood lineages, and in the differentiation and/or proliferation of various cell types.

Additionally, the albumin fusion proteins of the invention and polynucleotides encoding albumin fusion proteins of the invention, may also be employed to inhibit the proliferation and differentiation of hematopoietic cells and therefore may be employed to protect bone marrow stem cells from chemotherapeutic agents during chemotherapy. This antiproliferative effect may allow administration of higher doses of chemotherapeutic agents and, therefore, more effective chemotherapeutic treatment.

Moreover, fusion proteins of the invention and polynucleotides encoding albumin fusion proteins of the invention may also be useful for the treatment and diagnosis of hematopoietic related disorders such as, anemia, pancytopenia, leukopenia, thrombocytopenia or leukemia, since stromal cells are important in the production of cells of hematopoietic lineages. The uses include bone marrow cell ex-vivo culture, bone marrow transplantation, bone marrow reconstitution, radiotherapy or chemotherapy of neoplasia.

Example 37

Human Dermal Fibroblast and Aortic Smooth Muscle Cell Proliferation

An albumin fusion protein of the invention is added to cultures of normal human dermal fibroblasts (NHDF) and human aortic smooth muscle cells (AoSMC) and two co-assays are performed with each sample. The first assay examines the effect of the fusion protein on the proliferation of normal human dermal fibroblasts (NHDF) or aortic smooth muscle cells (AoSMC). Aberrant growth of fibroblasts or smooth muscle cells is a part of several pathological processes, including fibrosis, and restenosis. The second assay examines IL6 production by both NHDF and SMC. IL6 production is an indication of functional activation. Activated cells will have increased production of a number of cytokines and other factors, which can result in a proinflammatory or immunomodulatory outcome. Assays are run with and without co-TNFa stimulation, in order to check for costimulatory or inhibitory activity.

Briefly, on day 1, 96-well black plates are set up with 1000 cells/well (NHDF) or 2000 cells/well (AoSMC) in 100 μl culture media. NHDF culture media contains: Clonetics FB basal media, 1 mg/ml hFGF, 5 mg/ml insulin, 50 mg/ml gentamycin, 2% FBS, while AoSMC culture media contains Clonetics SM basal media, 0.5 μg/ml hEGF, 5 mg/ml insulin, 1 μg/ml hFGF, 50 mg/ml gentamycin, 50 μg/ml Amphotericin B, 5% FBS. After incubation at 37° C. for at least 4-5 hours culture media is aspirated and replaced with growth arrest media. Growth arrest media for NHDF contains fibroblast basal media, 50 mg/ml gentamycin, 2% FBS, while growth arrest media for AoSMC contains SM basal media, 50 mg/ml gentamycin, 50 μg/ml Amphotericin B, 0.4% FBS. Incubate at 37° C. until day 2.

On day 2, serial dilutions and templates of an albumin fusion protein of the invention are designed such that they always include media controls and known-protein controls. For both stimulation and inhibition experiments, proteins are diluted in growth arrest media. For inhibition experiments, TNFa is added to a final concentration of 2 ng/ml (NHDF) or 5 ng/ml (AoSMC). Add ⅓ vol media containing controls or an albumin fusion protein of the invention and incubate at 37 degrees C./5% $CO_2$ until day 5.

Transfer 60 μl from each well to another labeled 96-well plate, cover with a plate-sealer, and store at 4 degrees C. until Day 6 (for IL6 ELISA). To the remaining 100 μl in the cell culture plate, aseptically add Alamar Blue in an amount equal to 10% of the culture volume (10 μl). Return plates to incubator for 3 to 4 hours. Then measure fluorescence with excitation at 530 nm and emission at 590 nm using the CytoFluor. This yields the growth stimulation/inhibition data.

On day 5, the IL6 ELISA is performed by coating a 96 well plate with 50-100 ul/well of Anti-Human IL6 Monoclonal antibody diluted in PBS, pH 7.4, incubate ON at room temperature.

On day 6, empty the plates into the sink and blot on paper towels. Prepare Assay Buffer containing PBS with 4% BSA. Block the plates with 200 μl/well of Pierce Super Block blocking buffer in PBS for 1-2 hr and then wash plates with wash buffer (PBS, 0.05% Tween-20). Blot plates on paper towels. Then add 50 μl/well of diluted Anti-Human IL-6 Monoclonal, Biotin-labeled antibody at 0.50 mg/ml. Make dilutions of IL-6 stock in media (30, 10, 3, 1, 0.3, 0 ng/ml). Add duplicate samples to top row of plate. Cover the plates and incubate for 2 hours at RT on shaker.

Plates are washed with wash buffer and blotted on paper towels. Dilute EU-labeled Streptavidin 1:1000 in Assay buffer, and add 100 μl/well. Cover the plate and incubate 1 h at RT. Plates are again washed with wash buffer and blotted on paper towels.

Add 100 μl/well of Enhancement Solution. Shake for 5 minutes. Read the plate on the Wallac DELFIA Fluorometer. Readings from triplicate samples in each assay were tabulated and averaged.

A positive result in this assay suggests AoSMC cell proliferation and that the albumin fusion protein may be involved in dermal fibroblast proliferation and/or smooth muscle cell proliferation. A positive result also suggests many potential uses of the fusion protein and polynucleotides encoding the albumin fusion protein. For example, inflammation and immune responses, wound healing, and angiogenesis, as detailed throughout this specification. Particularly, fusion proteins may be used in wound healing and dermal regeneration, as well as the promotion of vasculogenesis, both of the blood vessels and lymphatics. The growth of vessels can be used in the treatment of, for example, cardiovascular diseases. Additionally, fusion proteins showing antagonistic activity in this assay may be useful in treating diseases, disorders, and/or conditions which involve angiogenesis by acting as an anti-vascular agent (e.g., anti-angiogenesis). These diseases, disorders, and/or conditions are known in the art and/or are described herein, such as, for example, malignancies, solid tumors, benign tumors, for example hemangiomas, acoustic neuromas, neurofibromas, trachomas, and pyogenic granulomas; artheroscleric plaques; ocular angiogenic diseases, for example, diabetic retinopathy, retinopathy of prematurity, macular degeneration, corneal graft rejection, neovascular glaucoma, retrolental fibroplasia, rubeosis, retinoblastoma, uvietis and Pterygia (abnormal blood vessel growth) of the eye; rheumatoid arthritis; psoriasis; delayed wound healing; endometriosis; vasculogenesis; granulations; hypertrophic scars (keloids); nonunion fractures; scleroderma; trachoma; vascular adhesions; myocardial angiogenesis; coronary collaterals; cerebral collaterals; arteriovenous malformations; ischemic limb angiogenesis; Osler-Webber Syndrome; plaque neovascularization; telangiectasia; hemophiliac joints; angiofibroma; fibromuscular dysplasia; wound granulation; Crohn's disease; and atherosclerosis. Moreover, albumin fusion proteins that act as antagonists in this assay may be useful in treating anti-hyperproliferative diseases and/or anti-inflammatory known in the art and/or described herein.

Example 38

Cellular Adhesion Molecule (CAM) Expression on Endothelial Cells

The recruitment of lymphocytes to areas of inflammation and angiogenesis involves specific receptor-ligand interactions between cell surface adhesion molecules (CAMs) on lymphocytes and the vascular endothelium. The adhesion process, in both normal and pathological settings, follows a multi-step cascade that involves intercellular adhesion molecule-1 (ICAM-1), vascular cell adhesion molecule-1 (VCAM-1), and endothelial leukocyte adhesion molecule-1 (E-selectin) expression on endothelial cells (EC). The expression of these molecules and others on the vascular endothelium determines the efficiency with which leukocytes may adhere to the local vasculature and extravasate into the local tissue during the development of an inflammatory response. The local concentration of cytokines and growth factor participate in the modulation of the expression of these CAMs.

Briefly, endothelial cells (e.g., Human Umbilical Vein Endothelial cells (HUVECs)) are grown in a standard 96 well plate to confluence, growth medium is removed from the cells and replaced with 100 μl of 199 Medium (10% fetal bovine serum (FBS)). Samples for testing (containing an albumin fusion protein of the invention) and positive or negative controls are added to the plate in triplicate (in 10 μl volumes). Plates are then incubated at 37° C. for either 5 h (selectin and integrin expression) or 24 h (integrin expression only). Plates are aspirated to remove medium and 100 μl of 0.1% paraformaldehyde-PBS(with Ca++ and Mg++) is added to each well. Plates are held at 4° C. for 30 min. Fixative is removed from the wells and wells are washed 1× with PBS(+Ca,Mg)+0.5% BSA and drained. 10 μl of diluted primary antibody is added to the test and control wells. Anti-ICAM-1-Biotin, Anti-VCAM-1-Biotin and Anti-E-selectin-Biotin are used at a concentration of 10 μg/ml (1:10 dilution of 0.1 mg/ml stock antibody). Cells are incubated at 37° C. for 30 min. in a humidified environment. Wells are washed three times with PBS(+Ca,Mg)+0.5% BSA. 20 μl of diluted ExtrAvidin-Alkaline Phosphatase (1:5,000 dilution, referred to herein as the working dilution) are added to each well and incubated at 37° C. for 30 min. Wells are washed three times with PBS(+Ca, Mg)+0.5% BSA. Dissolve 1 tablet of p-Nitrophenol Phosphate pNPP per 5 ml of glycine buffer (pH 10.4). 100 μl of pNPP substrate in glycine buffer is added to each test well. Standard wells in triplicate are prepared from the working dilution of the ExtrAvidin-Alkaline Phosphotase in glycine buffer: 1:5,000 ($10^0$)>$10^{-0.5}$>$10^{-1}$>$10^{-1.5}$0.5 μl of each dilution is added to triplicate wells and the resulting AP content in each well is 5.50 ng, 1.74 ng, 0.55 ng, 0.18 ng. 100 μl of pNNP reagent is then added to each of the standard wells. The plate is incubated at 37° C. for 4 h. A volume of 50 μl of 3M NaOH is added to all wells. The plate is read on a plate reader at 405 nm using the background subtraction option on blank wells filled with glycine buffer only. Additionally, the template is set up to indicate the concentration of AP-conjugate in each standard well [5.50 ng; 1.74 ng; 0.55 ng; 0.18 ng]. Results are indicated as amount of bound AP-conjugate in each sample.

Example 39

Alamar Blue Endothelial Cells Proliferation Assay

This assay may be used to quantitatively determine protein mediated inhibition of bFGF-induced proliferation of Bovine Lymphatic Endothelial Cells (LECs), Bovine Aortic Endothelial Cells (BAECs) or Human Microvascular Uterine Myometrial Cells (UTMECs). This assay incorporates a fluorometric growth indicator based on detection of metabolic activity. A standard Alamar Blue Proliferation Assay is prepared in EGM-2MV with 10 ng/ml of bFGF added as a source of endothelial cell stimulation. This assay may be used with a variety of endothelial cells with slight changes in growth medium and cell concentration. Dilutions of protein batches to be tested are diluted as appropriate. Serum-free medium (GIBCO SFM) without bFGF is used as a non-stimulated control and Angiostatin or TSP-1 are included as a known inhibitory controls.

Briefly, LEC, BAECs or UTMECs are seeded in growth media at a density of 5000 to 2000 cells/well in a 96 well plate and placed at 37 degrees C. overnight. After the overnight incubation of the cells, the growth media is removed and replaced with GIBCO EC-SFM. The cells are treated with the appropriate dilutions of an albumin fusion protein of the invention or control protein sample(s) (prepared in SFM) in triplicate wells with additional bFGF to a concentration of 10 ng/ml. Once the cells have been treated with the samples, the plate(s) is/are placed back in the 37° C. incubator for three days. After three days 10 ml of stock alamar blue (Biosource Cat#DAL1100) is added to each well and the plate(s) is/are placed back in the 37° C. incubator for four hours. The plate (s) are then read at 530 nm excitation and 590 nm emission using the CytoFluor fluorescence reader. Direct output is recorded in relative fluorescence units.

Alamar blue is an oxidation-reduction indicator that both fluoresces and changes color in response to chemical reduction of growth medium resulting from cell growth. As cells grow in culture, innate metabolic activity results in a chemical reduction of the immediate surrounding environment. Reduction related to growth causes the indicator to change from oxidized (non-fluorescent blue) form to reduced (fluorescent red) form (i.e., stimulated proliferation will produce a stronger signal and inhibited proliferation will produce a weaker signal and the total signal is proportional to the total number of cells as well as their metabolic activity). The background level of activity is observed with the starvation medium alone. This is compared to the output observed from the positive control samples (bFGF in growth medium) and protein dilutions.

Example 40

Detection of Inhibition of a Mixed Lymphocyte Reaction

This assay can be used to detect and evaluate inhibition of a Mixed Lymphocyte Reaction (MLR) by fusion proteins of the invention. Inhibition of a MLR may be due to a direct effect on cell proliferation and viability, modulation of costimulatory molecules on interacting cells, modulation of adhesiveness between lymphocytes and accessory cells, or modulation of cytokine production by accessory cells. Multiple cells may be targeted by the albumin fusion proteins that inhibit MLR since the peripheral blood mononuclear fraction used in this assay includes T, B and natural killer lymphocytes, as well as monocytes and dendritic cells.

Albumin fusion proteins of the invention found to inhibit the MLR may find application in diseases associated with lymphocyte and monocyte activation or proliferation. These include, but are not limited to, diseases such as asthma, arthritis, diabetes, inflammatory skin conditions, psoriasis, eczema, systemic lupus erythematosus, multiple sclerosis, glomerulonephritis, inflammatory bowel disease, crohn's disease, ulcerative colitis, arteriosclerosis, cirrhosis, graft vs. host disease, host vs. graft disease, hepatitis, leukemia and lymphoma.

Briefly, PBMCs from human donors are purified by density gradient centrifugation using Lymphocyte Separation Medium (LSM®, density 1.0770 g/ml, Organon Teknika Corporation, West Chester, Pa.). PBMCs from two donors are adjusted to $2\times10^6$ cells/ml in RPMI-1640 (Life Technologies, Grand Island, N.Y.) supplemented with 10% FCS and 2 mM glutamine. PBMCs from a third donor is adjusted to $2\times10^5$ cells/ml. Fifty microliters of PBMCs from each donor is added to wells of a 96-well round bottom microtiter plate. Dilutions of the fusion protein test material (50 μl) is added in triplicate to microtiter wells. Test samples (of the protein of interest) are added for final dilution of 1:4; rhuIL-2 (R&D Systems, Minneapolis, Minn., catalog number 202-IL) is added to a final concentration of 1 μg/ml; anti-CD4 mAb (R&D Systems, clone 34930.11, catalog number MAB379) is added to a final concentration of 10 μg/ml. Cells are cultured for 7-8 days at 37° C. in 5% $CO_2$, and 1 PC of [$^3$H] thymidine is added to wells for the last 16 hrs of culture. Cells are harvested and thymidine incorporation determined using a Packard TopCount. Data is expressed as the mean and standard deviation of triplicate determinations.

Samples of the fusion protein of interest are screened in separate experiments and compared to the negative control treatment, anti-CD4 mAb, which inhibits proliferation of lymphocytes and the positive control treatment, IL-2 (either as recombinant material or supernatant), which enhances proliferation of lymphocytes.

Example 41

Assays for Protease Activity

The following assay may be used to assess protease activity of an albumin fusion protein of the invention.

Gelatin and casein zymography are performed essentially as described (Heusen et al., *Anal. Biochem.,* 102:196-202 (1980); Wilson et al., *Journal of Urology,* 149:653-658 (1993)). Samples are run on 10% polyacryamide/0.1% SDS gels containing 1% gelain orcasein, soaked in 2.5% triton at room temperature for 1 hour, and in 0.1M glycine, pH 8.3 at 37° C. 5 to 16 hours. After staining in amido black areas of proteolysis appear as clear areas against the blue-black background. Trypsin (Sigma T8642) is used as a positive control.

Protease activity is also determined by monitoring the cleavage of n-a-benzoyl-L-arginine ethyl ester (BAEE) (Sigma B-4500. Reactions are set up in (25 mMNaPO$_4$, 1 mM EDTA, and 1 mM BAEE), pH 7.5. Samples are added and the change in absorbance at 260 nm is monitored on the Beckman DU-6 spectrophotometer in the time-drive mode. Trypsin is used as a positive control.

Additional assays based upon the release of acid-soluble peptides from casein or hemoglobin measured as absorbance at 280 nm or calorimetrically using the Folin method are performed as described in Bergmeyer, et al., *Methods of Enzymatic Analysis,* 5 (1984). Other assays involve the solubilization of chromogenic substrates (Ward, *Applied Science,* 251-317 (1983)).

Example 42

Identifying Serine Protease Substrate Specificity

Methods known in the art or described herein may be used to determine the substrate specificity of the albumin fusion proteins of the present invention having serine protease activity. A preferred method of determining substrate specificity is by the use of positional scanning synthetic combinatorial libraries as described in GB 2 324 529 (incorporated herein in its entirety).

Example 43

Ligand Binding Assays

The following assay may be used to assess ligand binding activity of an albumin fusion protein of the invention.

Ligand binding assays provide a direct method for ascertaining receptor pharmacology and are adaptable to a high throughput format. The purified ligand for an albumin fusion protein of the invention is radiolabeled to high specific activity (50-2000 Ci/ηµmol) for binding studies. A determination is then made that the process of radiolabeling does not diminish the activity of the ligand towards the fusion protein. Assay conditions for buffers, ions, pH and other modulators such as nucleotides are optimized to establish a workable signal to noise ratio for both membrane and whole cell polypeptide sources. For these assays, specific polypeptide binding is defined as total associated radioactivity minus the radioactivity measured in the presence of an excess of unlabeled competing ligand. Where possible, more than one competing ligand is used to define residual nonspecific binding.

Example 44

Functional Assay in *Xenopus* Oocytes

Capped RNA transcripts from linearized plasmid templates encoding an albumin fusion protein of the invention is synthesized in vitro with RNA polymerases in accordance with standard procedures. In vitro transcripts are suspended in water at a final concentration of 0.2 mg/ml. Ovarian lobes are removed from adult female toads, Stage V defolliculated oocytes are obtained, and RNA transcripts (10 ng/oocytc) are injected in a 50 nl bolus using a microinjection apparatus. Two electrode voltage clamps are used to measure the currents from individual *Xenopus* oocytes in response fusion protein and polypeptide agonist exposure. Recordings are made in Ca2+ free Barth's medium at room temperature. The *Xenopus* system can be used to screen known ligands and tissue/cell extracts for activating ligands.

Example 45

Microphysiometric Assays

Activation of a wide variety of secondary messenger systems results in extrusion of small amounts of acid from a cell. The acid formed is largely as a result of the increased metabolic activity required to fuel the intracellular signaling process. The pH changes in the media surrounding the cell are very small but are detectable by the CYTOSENSOR microphysiometer (Molecular Devices Ltd., Menlo Park, Calif.). The CYTOSENSOR is thus capable of detecting the ability of an albumin fusion protein of the invention to activate secondary messengers that are coupled to an energy utilizing intracellular signaling pathway.

Example 46

Extract/Cell Supernatant Screening

A large number of mammalian receptors exist for which there remains, as yet, no cognate activating ligand (agonist). Thus, active ligands for these receptors may not be included within the ligands banks as identified to date. Accordingly, the albumin fusion proteins of the invention can also be functionally screened (using calcium, cAMP, microphysiometer, oocyte electrophysiology, etc., functional screens) against tissue extracts to identify natural ligands for the Therapeutic protein portion and/or albumin protein portion of an albumin fusion protein of the invention. Extracts that produce positive functional responses can be sequentially subfractionated until an activating ligand is isolated and identified.

Example 47

ATP-Binding Assay

The following assay may be used to assess ATP-binding activity of fusion proteins of the invention.

ATP-binding activity of an albumin fusion protein of the invention may be detected using the ATP-binding assay described in U.S. Pat. No. 5,858,719, which is herein incorporated by reference in its entirety. Briefly, ATP-binding to an albumin fusion protein of the invention is measured via photoaffinity labeling with 8-azido-ATP in a competition assay. Reaction mixtures containing 1 mg/ml of ABC transport protein are incubated with varying concentrations of ATP, or the non-hydrolyzable ATP analog adenyl-5'-imidodiphosphate for 10 minutes at 4° C. A mixture of 8-azido-ATP (Sigma Chem. Corp., St. Louis, Mo.) plus 8-azido-ATP ($^{32}$P-ATP) (5 mCi/µmol, ICN, Irvine Calif.) is added to a final concentration of 100 µM and 0.5 ml aliquots are placed in the wells of a porcelain spot plate on ice. The plate is irradiated using a short wave 254 nm UV lamp at a distance of 2.5 cm from the plate for two one-minute intervals with a one-minute cooling interval in between. The reaction is stopped by addition of dithiothreitol to a final concentration of 2 mM. The incubations are subjected to SDS-PAGE electrophoresis, dried, and autoradiographed. Protein bands corresponding to the albumin fusion proteins of the invention are excised, and the radioactivity quantified. A decrease in radioactivity with increasing ATP or adenly-5'-imidodiphosphate provides a measure of ATP affinity to the fusion protein.

Example 48

Identification of Signal Transduction Proteins that Interact with an albumin fusion Protein of the Present Invention Albumin fusion proteins of the invention may serve as research tools for the identification, characterization and purification of signal transduction pathway proteins or receptor proteins. Briefly, a labeled fusion protein of the invention is useful as a reagent for the purification of molecules with which it interacts. In one embodiment of affinity purification, an albumin fusion protein of the invention is covalently coupled to a chromatography column. Cell-free extract derived from putative target cells, such as carcinoma tissues, is passed over the column, and molecules with appropriate affinity bind to the albumin fusion protein. The protein complex is recovered from the column, dissociated, and the recovered molecule subjected to N-terminal protein sequencing. This amino acid sequence is then used to identify the captured molecule or to design degenerate oligonucleotide probes for cloning the relevant gene from an appropriate cDNA library.

Example 49

IL-6 Bioassay

A variety of assays are known in the art for testing the proliferative effects of an albumin fusion protein of the invention. For example, one such assay is the IL-6 Bioassay as described by Marz et al. (*Proc. Natl. Acad. Sci., USA.,* 95:3251-56 (1998), which is herein incorporated by reference). After 68 hrs. at 37° C., the number of viable cells is measured by adding the tetrazolium salt thiazolyl blue (MTT) and incubating for a further 4 hrs. at 37° C. B9 cells are lysed by SDS and optical density is measured at 570 nm. Controls containing IL-6 positive) and no cytokine (negative) are Briefly, IL-6 dependent B9 murine cells are washed three times in IL-6 free medium and plated at a concentration of 5,000 cells per well in 50 μl, and 50 μl of fusion protein of the invention is added. utilized. Enhanced proliferation in the test sample(s) (containing an albumin fusion protein of the invention) relative to the negative control is indicative of proliferative effects mediated by the fusion protein.

Example 50

Support of Chicken Embryo Neuron Survival

To test whether sympathetic neuronal cell viability is supported by an albumin fusion protein of the invention, the chicken embryo neuronal survival assay of Senaldi et al may be utilized (*Proc. Natl. Acad. Sci., U.S.A.,* 96:11458-63 (1998), which is herein incorporated by reference). Briefly, motor and sympathetic neurons are isolated from chicken embryos, resuspended in L15 medium (with 10% FCS, glucose, sodium selenite, progesterone, conalbumin, putrescine, and insulin; Life Technologies, Rockville, Md.) and Dulbecco's modified Eagles medium [with 10% FCS, glutamine, penicillin, and 25 mM Hepes buffer (pH 7.2); Life Technologies, Rockville, Md.], respectively, and incubated at 37° C. in 5% $CO_2$ in the presence of different concentrations of the purified fusion protein of the invention, as well as a negative control lacking any cytokine. After 3 days, neuron survival is determined by evaluation of cellular morphology, and through the use of the colorimetric assay of Mosmann (Mosmann, T., *J. Immunol. Methods,* 65:55-63 (1983)). Enhanced neuronal cell viability as compared to the controls lacking cytokine is indicative of the ability of the albumin fusion protein to enhance the survival of neuronal cells.

Example 51

Assay for Phosphatase Activity

The following assay may be used to assess serine/threonine phosphatase (PTPase) activity of an albumin fusion protein of the invention.

In order to assay for serine/threonine phosphatase (PTPase) activity, assays can be utilized which are widely known to those skilled in the art. For example, the serine/threonine phosphatase (PSPase) activity of an albumin fusion protein of the invention may be measured using a PSPase assay kit from New England Biolabs, Inc. Myelin basic protein (MyBP), a substrate for PSPase, is phosphorylated on serine and threonine residues with cAMP-dependent Protein Kinase in the presence of [$^{32}$P]ATP. Protein serine/threonine phosphatase activity is then determined by measuring the release of inorganic phosphate from 32P-labeled MyBP.

Example 52

Interaction of Serine/Threonine Phosphatases with Other Proteins

Fusion proteins of the invention having serine/threonine phosphatase activity (e.g., as determined in Example 51) are useful, for example, as research tools for the identification, characterization and purification of additional interacting proteins or receptor proteins, or other signal transduction pathway proteins. Briefly, a labeled fusion protein of the invention is useful as a reagent for the purification of molecules with which it interacts. In one embodiment of affinity purification, an albumin fusion protein of the invention is covalently coupled to a chromatography column. Cell-free extract derived from putative target cells, such as neural or liver cells, is passed over the column, and molecules with appropriate affinity bind to the fusion protein. The fusion protein-complex is recovered from the column, dissociated, and the recovered molecule subjected to N-terminal protein sequencing. This amino acid sequence is then used to identify the captured molecule or to design degenerate oligonucleotide probes for cloning the relevant gene from an appropriate cDNA library.

Example 53

Assaying for Heparanase Activity

There a numerous assays known in the art that may be employed to assay for heparanase activity of an albumin fusion protein of the invention. In one example, heparanase activity of an albumin fusion protein of the invention, is assayed as described by Vlodavsky et al., (Vlodavsky et al., Nat. Med., 5:793-802 (1999)). Briefly, cell lysates, conditioned media, intact cells ($1\times10^6$ cells per 35-mm dish), cell culture supernatant, or purified fusion protein are incubated for 18 hrs at 37° C., pH 6.2-6.6, with $^{35}$S-labeled ECM or soluble ECM derived peak I proteoglycans. The incubation medium is centrifuged and the supernatant is analyzed by gel filtration on a Sepharose CL-6B column (0.9×30 cm). Fractions are eluted with PBS and their radioactivity is measured. Degradation fragments of heparan sulfate side chains are eluted from Sepharose 6B at $0.5<K_{av}<0.8$ (peak II). Each experiment is done at least three times. Degradation fragments corresponding to "peak II," as described by Vlodavsky et al., is indicative of the activity of an albumin fusion protein of the invention in cleaving heparan sulfate.

Example 54

Immobilization of Biomolecules

This example provides a method for the stabilization of an albumin fusion protein of the invention in non-host cell lipid bilayer constucts (see, e.g., Bieri et al., Nature Biotech 17:1105-1108 (1999), hereby incorporated by reference in its entirety herein) which can be adapted for the study of fusion proteins of the invention in the various functional assays described above. Briefly, carbohydrate-specific chemistry for biotinylation is used to confine a biotin tag to an albumin fusion protein of the invention, thus allowing uniform orientation upon immobilization. A 50 uM solution of an albumin fusion protein of the invention in washed membranes is incubated with 20 mM NaIO4 and 1.5 mg/ml (4 mM) BACH or 2 mg/ml (7.5 mM) biotin-hydrazide for 1 hr at room temperature (reaction volume, 150 ul). Then the sample is dialyzed (Pierce Slidealizer Cassett, 10 kDa cutoff, Pierce Chemical Co., Rockford Ill.) at 4 C first for 5 h, exchanging the buffer after each hour, and finally for 12 h against 500 ml buffer R (0.15 M NaCl, 1 mM MgCl2, 10 mM sodium phosphate, pH7). Just before addition into a cuvette, the sample is diluted 1:5 in buffer ROG50 (Buffer R supplemented with 50 mM octylglucoside).

Example 55

Assays for Metalloproteinase Activity

Metalloproteinases are peptide hydrolases which use metal ions, such as $Zn^{2+}$, as the catalytic mechanism. Metalloproteinase activity of an albumin fusion protein of the present invention can be assayed according to methods known in the art. The following exemplary methods are provided:

Proteolysis of alpha-2-macroglobulin

To confirm protease activity, a purified fusion protein of the invention is mixed with the substrate alpha-2-macroglobulin (0.2 unit/ml; Boehringer Mannheim, Germany) in 1× assay buffer (50 mM HEPES, pH 7.5, 0.2 M NaCl, 10 mM $CaCl_2$, 25 μM $ZnCl_2$ and 0.05% Brij-35) and incubated at 37° C. for 1-5 days. Trypsin is used as positive control. Negative controls contain only alpha-2-macroglobulin in assay buffer. The samples are collected and boiled in SDS-PAGE sample buffer containing 5% 2-mercaptoethanol for 5-min, then loaded onto 8% SDS-polyacrylamide gel. After electrophoresis the proteins are visualized by silver staining. Proteolysis is evident by the appearance of lower molecular weight bands as compared to the negative control.

Inhibition of alpha-2-macroglobulin proteolysis by inhibitors of metalloproteinases Known metalloproteinase inhibitors (metal chelators (EDTA, EGTA, AND $HgCl_2$), peptide metalloproteinase inhibitors (TIMP-1 and TIMP 2), and commercial small molecule MMP inhibitors) may also be used to characterize the proteolytic activity of an albumin fusion protein of the invention. Three synthetic MMP inhibitors that may be used are: MMP inhibitor I, [$IC_{50}$=1.0 μM against MMP-1 and MMP 8; $IC_{50}$=30 μM against MMP-9; $IC_{50}$=150 μM against MMP-3]; MMP-3 (stromelysin-1) inhibitor I [$IC_{50}$=5 μM against MMP-3], and MMP-3 inhibitor II [$K_i$=130 nM against MMP-3]; inhibitors available through Calbiochem, catalog #444250, 444218, and 444225, respectively). Briefly, different concentrations of the small molecule MMP inhibitors are mixed with a purified fusion protein of the invention (50 μg/ml) in 22.9 μl of 1×HEPES buffer (50 mM HEPES, pH 7.5, 0.2 M NaCl, 10 mM $CaCl_2$, 25 μM $ZnCl_2$ and 0.05% Brij-35) and incubated at room temperature (24° C.) for 2-hr, then 7.1 μl of substrate alpha-2-macroglobulin (0.2 unit/ml) is added and incubated at 37° C. for 20-hr. The reactions are stopped by adding 4× sample buffer and boiled immediately for 5 minutes. After SDS-PAGE, the protein bands are visualized by silver stain.

Synthetic Fluorogenic Peptide Substrates Cleavage Assay

The substrate specificity for fusion proteins of the invention with demonstrated metalloproteinase activity may be determined using techniques known in the art, such as using synthetic fluorogenic peptide substrates (purchased from BACHEM Bioscience Inc). Test substrates include, M-1985, M-2225, M-2105, M-2110, and M-2255. The first four are MMP substrates and the last one is a substrate of tumor necrosis factor-α (TNF-α) converting enzyme (TACE). These substrates are preferably prepared in 1:1 dimethyl sulfoxide (DMSO) and water. The stock solutions are 50-500 μM. Fluorescent assays are performed by using a Perkin Elmer LS 50B luminescence spectrometer equipped with a constant temperature water bath. The excitation λ is 328 nm and the emission λ is 393 nm. Briefly, the assay is carried out by incubating 176 μl 1×HEPES buffer (0.2 M NaCl, 10 mM $CaCl_2$, 0.05% Brij-35 and 50 mM HEPES, pH 7.5) with 4 μl of substrate solution (50 μM) at 25° C. for 15 minutes, and then adding 20 μl of a purified fusion protein of the invention into the assay cuvett. The final concentration of substrate is 1 μM. Initial hydrolysis rates are monitored for 30-min.

Example 56

Occurrence of Diabetes in NOD Mice

Female NOD (non-obese diabetic) mice are characterized by displaying IDDM with a course which is similar to that found in humans, although the disease is more pronounced in female than male NOD mice. Hereinafter, unless otherwise stated, the term "NOD mouse" refers to a female NOD mouse. NOD mice have a progressive destruction of beta cells which is caused by a chronic autoimmune disease. Thus, NOD mice begin life with euglycemia, or normal blood glucose levels. By about 15 to 16 weeks of age, however, NOD mice start becoming hyperglycemic, indicating the destruction of the majority of their pancreatic beta cells and the corresponding inability of the pancreas to produce sufficient insulin. Thus, both the cause and the progression of the disease are similar to human IDDM patients.

In vivo assays of efficacy of the immunization regimens can be assessed in female NOD/LtJ mice (commercially available from The Jackson Laboratory, Bar Harbor, Me.). In the literature, it's reported that 80% of female mice develop diabetes by 24 weeks of age and onset of insulitis begins between 6-8 weeks age. NOD mice are inbred and highly responsive to a variety of immunoregulatory strategies. Adult NOD mice (6-8 weeks of age) have an average mass of 20-25 g.

These mice can be either untreated (control), treated with the therapeutics of the subject invention (e.g., albumin fusion proteins of the invention and fragments and variants thereof), alone or in combination with other therapeutic compounds stated above. The effect of these various treatments on the progression of diabetes can be measured as follows:

At 14 weeks of age, the female NOD mice can be phenotyped according to glucose tolerance. Glucose tolerance can be measured with the intraperitoneal glucose tolerance test (IPGTT). Briefly, blood is drawn from the paraorbital plexus at 0 minutes and 60 minutes after the intraperitoneal injection of glucose (1 g/kg body weight). Normal tolerance is defined as plasma glucose at 0 minutes of less than 144 mg %, or at 60 minutes of less than 160 mg %. Blood glucose levels are determined with a Glucometer Elite apparatus.

Based upon this phenotypic analysis, animals can be allocated to the different experimental groups. In particular, animals with more elevated blood glucose levels can be assigned to the impaired glucose tolerance group. The mice can be fed ad libitum and can be supplied with acidified water (pH 2.3).

The glucose tolerant and intolerant mice can be further subdivided into control, albumin fusion proteins of the subject invention, and albumin fusion proteins/therapeutic compounds combination groups. Mice in the control group can receive an interperitoneal injection of vehicle daily, six times per week. Mice in the albumin fusion group can receive an interperitoneal injection of the therapeutics of the subject invention (e.g., albumin fusion proteins of the invention and fragments and variants thereof) in vehicle daily, six times per week. Mice in the albumin fusion proteins/therapeutic compounds combination group can receive both albumin fusion proteins and combinations of therapeutic compounds as described above.

The level of urine glucose in the NOD mice can be determined on a bi-weekly basis using Labstix (Bayer Diagnostics, Hampshire, England). Weight and fluid intake can also be determined on a bi-weekly basis. The onset of diabetes is defined after the appearance of glucosuria on two consecutive determinations. After 10 weeks of treatment, an additional IPGTT can be performed and animals can be sacrificed the following day.

Over the 10 week course of treatment, control animals in both the glucose tolerant and glucose intolerant groups develop diabetes at a rate of 60% and 86%, respectively (see U.S. Pat. No. 5,866,546, Gross et al.). Thus, high rates of diabetes occur even in NOD mice which are initially glucose tolerant if no intervention is made.

Results can be confirmed by the measurement of blood glucose levels in NOD mice, before and after treatment. Blood glucose levels are measured as described above in both glucose tolerant and intolerant mice in all groups described.

In an alternative embodiment, the therapeutics of the subject invention (e.g., specific fusions disclosed as SEQ ID NO:Y and fragments and variants thereof) can be quantified using spectrometric analysis and appropriate protein quantities can be resuspended prior to injection in 50 .mu.1 phosphate buffered saline (PBS) per dose. Two injections, one week apart, can be administered subcutaneously under the dorsal skin of each mouse. Monitoring can be performed on two separate occasions prior to immunization and can be performed weekly throughout the treatment and continued thereafter. Urine can be tested for glucose every week (Keto-Diastix®; Miles Inc., Kankakee, Ill.) and glycosuric mice can be checked for serum glucose (ExacTech®, MediSense, Inc., Waltham, Mass.). Diabetes is diagnosed when fasting glycemia is greater than 2.5 g/L.

Example 57

Histological Examination of NOD Mice

Histological examination of tissue samples from NOD mice can demonstrate the ability of the compositions of the present invention, and/or a combination of the compositions of the present invention with other therapeutic agents for diabetes, to increase the relative concentration of beta cells in the pancreas. The experimental method is as follows:

The mice from Example 56 can be sacrificed at the end of the treatment period and tissue samples can be taken from the pancreas. The samples can be fixed in 10% formalin in 0.9% saline and embedded in wax. Two sets of 5 serial 5 .mu.m sections can be cut for immunolabelling at a cutting interval of 150 .mu.m. Sections can be immunolabelled for insulin (guinea pig anti-insulin antisera dilution 1:1000, ICN Thames U.K.) and glucagon (rabbit anti-pancreatic glucagon antisera dilution 1:2000) and detected with peroxidase conjugated anti-guinea pig (Dako, High Wycombe, U.K.) or peroxidase conjugated anti-rabbit antisera (dilution 1:50, Dako).

The composition of the present invention may or may not have as strong an effect on the visible mass of beta cells as it does on the clinical manifestations of diabetes in glucose tolerant and glucose intolerant animals.

Example 58

In Vivo Mouse Model of NIDDM

Male C57BL/6J mice from Jackson Laboratory (Bar Harbor, Me.) can be obtained at 3 weeks of age and fed on conventional chow or diets enriched in either fat (35.5% wv/wt; Bioserv.Frenchtown, N.J.) or fructose (60% wt/wt; Harlan Teklad, Madison, Wis.). The regular chow is composed of 4.5% wt/wt fat, 23% wt/wt protein, 31.9% wt/wt starch, 3.7% wt/wt fructose, and 5.3% wt/wt fiber. The high-fat (lard) diet is composed of 35.5% wt/wt fat, 20% wt/wt protein, 36.4% wt/wt starch, 0.0% wt/wt fructose, and 0.1% wt/wt fiber. The high-fructose diet is composed of 5% wt/wt fat, 20% wt/wt protein, 0.0% wt/wt starch, 60% wt/wt fructose, and 9.4% wt/wt fiber. The mice may be housed no more than five per cage at 22°±/−3° C. temperature- and 50%+/−20% humidity-controlled room with a 12-hour light (6 am to 6 pm)/dark cycle (Luo et al., 1998, Metabolism 47(6): 663-8, "Nongenetic mouse models of non-insulin-dependent diabetes mellitus"; Larsen et al., Diabetes 50(11): 2530-9 (2001), "Systemic administration of the long-acting GLP-1 derivative NN2211 induces lasting and reversible weight loss in both normal and obese rats"). After exposure to the respective diets for 3 weeks, mice can be injected intraperitoneally with either streptozotocin, "STZ" (Sigma, St. Louis, Mo.), at 100 mg/kg body weight or vehicle (0.05 mol/L citric acid, pH 4.5) and kept on the same diet for the next 4 weeks. Under non-fasting conditions, blood is obtained 1, 2, and 4 weeks post-STZ by nipping the distal part of the tail. Samples are used to measure nonfasting plasma glucose and insulin concentrations. Body weight and food intake are recorded weekly.

To directly determine the effect of the high-fat diet on the ability of insulin to stimulate glucose disposal, the experiments can be initiated on three groups of mice, fat-fed, chow-fed injected with vehicle, and fat-fed injected with STZ at the end of the 7-week period described above. Mice can be fasted for 4 hours before the experiments. In the first series of experiments, mice can be anesthetized with methoxyflurane (Pitman-Moor, Mundelein, Ill.) inhalation. Regular insulin (Sigma) can be injected intravenously ([IV] 0.1 U/kg body weight) through a tail vein, and blood can be collected 3, 6, 9, 12, and 15 minutes after the injection from a different tail vein. Plasma glucose concentrations can be determined on these samples, and the half-life (t½) of glucose disappearance from plasma can be calculated using WinNonlin (Scientific Consulting, Apex, N.C.), a pharmacokinetics/pharmacodynamics software program.

In the second series of experiments, mice can be anesthetized with intraperitoneal sodium pentobarbital (Sigma). The abdominal cavity is opened, and the main abdominal vein is exposed and catheterized with a 24-gauge IV catheter (Johnson-Johnson Medical, Arlington, Tex.). The catheter is secured to muscle tissue adjacent to the abdominal vein, cut on the bottom of the syringe connection, and hooked to a prefilled PE50 plastic tube, which in turn is connected to a syringe with infusion solution. The abdominal cavity is then sutured closed. With this approach, there would be no blockage of backflow of the blood from the lower part of the body. Mice can be infused continuously with glucose (24.1 mg/kg/min) and insulin (10 mU/kg/min) at an infusion volume of 10 μL/min. Retro-orbital blood samples (70 μL each) can be taken 90, 105, 120, and 135 minutes after the start of infusion for measurement of plasma glucose and insulin concentrations. The mean of these four samples is used to estimate steady-state plasma glucose (SSPG) and insulin (SSPI) concentrations for each animal.

Finally, experiments to evaluate the ability of the albumin fusion proteins, the therapeutic compositions of the instant application, either alone or in combination with any one or more of the therapeutic drugs listed for the treatment of diabetes mellitus, to decrease plasma glucose can be performed in the following two groups of "NIDDM" mice models that are STZ-injected: (1) fat-fed C57BL/6J, and (2) fructose-fed C57BL/6J. Plasma glucose concentrations of the mice for these studies may range from 255 to 555 mg/dL. Mice are randomly assigned to treatment with either vehicle, albumin fusion therapeutics of the present invention either alone or in combination with any one or more of the therapeutic drugs listed for the treatment of diabetes mellitus. A total of three doses can be administered. Tail vein blood samples can be taken for measurement of the plasma glucose concentration before the first dose and 3 hours after the final dose.

Plasma glucose concentrations can be determined using the Glucose Diagnostic Kit from Sigma (Sigma No. 315), an enzyme calorimetric assay. Plasma insulin levels can be determined using the Rat Insulin RIA Kit from Linco Research (#RI-13K; St. Charles, Mo.).

Example 59

In vitro H4Ile-SEAP Reporter Assays Establishing Involvement in Insulin Action The Various H4Ile Reporters H4Ile/rMEP-SEAP: The malic enzyme promoter isolated from rat (rMEP) contains a PPAR-gamma element which is in the insulin pathway. This reporter construct is stably transfected into the liver H4Ile cell-line.

H4Ile/SREBP-SEAP: The sterol regulatory element binding protein (SREBP-1c) is a transcription factor which acts on the promoters of a number of insulin-responsive genes, for example, fatty acid synthetase (FAS), and which regulates expression of key genes in fatty acid metabolism in fibroblasts, adipocytes, and hepatocytes. SREBP-1c, also known as the adipocyte determination and differentiation factor 1 (ADD-1), is considered as the primary mediator of insulin effects on gene expression in adipose cells. It's activity is modulated by the levels of insulin, sterols, and glucose. This reporter construct is stably transfected into the liver H4Ile cell-line.

H4Ile/FAS-SEAP: The fatty acid synthetase reporter constructs contain a minimal SREBP-responsive FAS promoter. This reporter construct is stably transfected into the liver H4Ile cell-line.

H4Ile/PEPCK-SEAP: The phosphoenolpyruvate carboxykinase (PEPCK) promoter is the primary site of hormonal regulation of PEPCK gene transcription modulating PEPCK activity. PEPCK catalyzes a committed and rate-limiting step in hepatic gluconeogenesis and must therefore be carefully controlled to maintain blood glucose levels within normal limits. This reporter construct is stably transfected into the liver H4Ile cell-line.

These reporter constructs can also be stably transfected into 3T3-L1 fibroblasts and L6 myoblasts. These stable cell-lines are then differentiated into 3T3-L1 adipocytes and L6 myotubes as previously described in Example 13. The differentiated cell-lines can then be used in the SEAP assay described below.

Growth and Assay Medium

The growth medium comprises 10% Fetal Bovine Serum (FBS), 10% Calf Serum, 1% NEAA, 1× penicillin/streptomycin, and 0.75 mg/mL G418 (for H4Ile/rFAS-SEAP and H4Ile/SREBP-SEAP) or 0.50 mg/mL G418 (for H4Ile/rMEP-SEAP). For H4Ile/PEPCK-SEAP, the growth medium consists of 10% FBS, 1% penicillin/streptomycin, 15 mM HEPES buffered saline, and 0.50 mg/mL G418.

The assay medium consists of low glucose DMEM medium (Life Technologies), 1% NEAA, 1× penicillin/streptomycin for the H4Ile/rFAS-SEAP, H4Ile/SREBP-SEAP, H4Ile/rMEP-SEAP reporters. The assay medium for H4Ile/PEPCK-SEAP reporter consists of 0.1% FBS, 1% penicillin/streptomycin, and 15 mM HEPES buffered saline.

Method

The 96-well plates are seeded at 75,000 cells/well in 100 μL/well of growth medium until cells in log growth phase become adherent. Cells are starved for 48 hours by replacing growth medium with assay medium, 200 μL/well. (For H4Ile/PEPCK-SEAP cells, assay medium containing 0.5 μM dexamethasone is added at 100 μL/well and incubated for approximately 20 hours). The assay medium is replaced thereafter with 100 μL/well of fresh assay medium, and a 50 μL aliquot of cell supernatant obtained from transfected cell-lines expressing the therapeutics of the subject invention (e.g., albumin fusion proteins of the invention and fragments and variants thereof) is added to the well. Supernatants from empty vector transfected cell-lines are used as negative control. Addition of 10 nM and/or 100 nM insulin to the wells is used as positive control. After 48 hours of incubation, the conditioned media are harvested and SEAP activity measured (Phospha-Light System protocol, Tropix #BP2500). Briefly, samples are diluted 1:4 in dilution buffer and incubated at 65° C. for 30 minutes to inactivate the endogenous non-placental form of SEAP. An aliquot of 50 μL of the diluted samples is mixed with 50 μL of SEAP Assay Buffer which contains a mixture of inhibitors active against the non-placental SEAP isoenzymes and is incubated for another 5 minutes. An aliquot of 50 μL of CSPD chemiluminescent substrate which is diluted 1:20 in Emerald luminescence enhancer is added to the mixture and incubated for 15-20 minutes. Plates are read in a Dynex plate luminometer.

Example 60

Transgenic Animals

The albumin fusion proteins of the invention can also be expressed in transgenic animals. Animals of any species, including, but not limited to, mice, rats, rabbits, hamsters, guinea pigs, pigs, micro-pigs, goats, sheep, cows and non-human primates, e.g., baboons, monkeys, and chimpanzees may be used to generate transgenic animals. In a specific embodiment, techniques described herein or otherwise known in the art, are used to express fusion proteins of the invention in humans, as part of a gene therapy protocol.

Any technique known in the art may be used to introduce the polynucleotides encoding the albumin fusion proteins of the invention into animals to produce the founder lines of transgenic animals. Such techniques include, but are not limited to, pronuclear microinjection (Paterson et al., Appl. Microbiol. Biotechnol. 40:691-698 (1994); Carver et al., Biotechnology (NY) 11:1263-1270 (1993); Wright et al., Biotechnology (NY) 9:830-834 (1991); and Hoppe et al., U.S. Pat. No. 4,873,191 (1989)); retrovirus mediated gene transfer into germ lines (Van der Putten et al., Proc. Natl. Acad. Sci., USA 82:6148-6152 (1985)), blastocysts or embryos; gene targeting in embryonic stem cells (Thompson et al., Cell 56:313-321 (1989)); electroporation of cells or embryos (Lo, 1983, Mol. Cell. Biol. 3:1803-1814 (1983)); introduction of the polynucleotides of the invention using a gene gun (see, e.g., Ulmer et al., Science 259:1745 (1993); introducing nucleic acid constructs into embryonic pleuripotent stem cells and transferring the stem cells back into the blastocyst; and sperm-mediated gene transfer (Lavitrano et al., Cell 57:717-723 (1989); etc. For a review of such techniques, see Gordon, "Transgenic Animals," Intl. Rev. Cytol. 115:171-229 (1989), which is incorporated by reference herein in its entirety.

Any technique known in the art may be used to produce transgenic clones containing polynucleotides encoding albumin fusion proteins of the invention, for example, nuclear transfer into enucleated oocytes of nuclei from cultured embryonic, fetal, or adult cells induced to quiescence (Campell et al., Nature 380:64-66 (1996); Wilmut et al., Nature 385:810-813 (1997)).

The present invention provides for transgenic animals that carry the polynucleotides encoding the albumin fusion proteins of the invention in all their cells, as well as animals which carry these polynucleotides in some, but not all their cells, i.e., mosaic animals or chimeric. The transgene may be integrated as a single transgene or as multiple copies such as in concatamers, e.g., head-to-head tandems or head-to-tail tandems. The transgene may also be selectively introduced into and activated in a particular cell type by following, for example, the teaching of Lasko et al. (Lasko et al., Proc. Natl. Acad. Sci. USA 89:6232-6236 (1992)). The regulatory sequences required for such a cell-type specific activation will depend upon the particular cell type of interest, and will be apparent to those of skill in the art. When it is desired that the polynucleotide encoding the fusion protein of the invention be integrated into the chromosomal site of the endogenous gene corresponding to the Therapeutic protein portion or albumin portion of the fusion protein of the invention, gene targeting is preferred. Briefly, when such a technique is to be utilized, vectors containing some nucleotide sequences homologous to the endogenous gene are designed for the purpose of integrating, via homologous recombination with chromosomal sequences, into and disrupting the function of the nucleotide sequence of the endogenous gene. The transgene may also be selectively introduced into a particular cell type, thus inactivating the endogenous gene in only that cell type, by following, for example, the teaching of Gu et al. (Gu et al., Science 265:103-106 (1994)). The regulatory sequences required for such a cell-type specific inactivation will depend upon the particular cell type of interest, and will be apparent to those of skill in the art.

Once transgenic animals have been generated, the expression of the recombinant gene may be assayed utilizing standard techniques. Initial screening may be accomplished by Southern blot analysis or PCR techniques to analyze animal tissues to verify that integration of the polynucleotide encoding the fusion protein of the invention has taken place. The level of mRNA expression of the polynucleotide encoding the fusion protein of the invention in the tissues of the transgenic animals may also be assessed using techniques which include, but are not limited to, Northern blot analysis of tissue samples obtained from the animal, in situ hybridization analysis, and reverse transcriptase-PCR (rt-PCR). Samples of fusion protein-expressing tissue may also be evaluated immunocytochemically or immunohistochemically using antibodies specific for the fusion protein.

Once the founder animals are produced, they may be bred, inbred, outbred, or crossbred to produce colonies of the particular animal. Examples of such breeding strategies include, but are not limited to: outbreeding of founder animals with more than one integration site in order to establish separate lines; inbreeding of separate lines in order to produce compound transgenics that express the transgene at higher levels because of the effects of additive expression of each transgene; crossing of heterozygous transgenic animals to produce animals homozygous for a given integration site in order to both augment expression and eliminate the need for screening of animals by DNA analysis; crossing of separate homozygous lines to produce compound heterozygous or homozygous lines; and breeding to place the transgene (i.e., polynucleotide encoding an albumin fusion protein of the invention) on a distinct background that is appropriate for an experimental model of interest.

Transgenic animals of the invention have uses which include, but are not limited to, animal model systems useful in elaborating the biological function of fusion proteins of the invention and the Therapeutic protein and/or albumin component of the fusion protein of the invention, studying conditions and/or disorders associated with aberrant expression, and in screening for compounds effective in ameliorating such conditions and/or disorders.

Example 61

Method of Treatment Using Gene Therapy-Ex Vivo

One method of gene therapy transplants fibroblasts, which are capable of expressing an albumin fusion protein of the present invention, onto a patient. Generally, fibroblasts are obtained from a subject by skin biopsy. The resulting tissue is placed in tissue-culture medium and separated into small pieces. Small chunks of the tissue are placed on a wet surface of a tissue culture flask, approximately ten pieces are placed in each flask. The flask is turned upside down, closed tight and left at room temperature over night. After 24 hours at room temperature, the flask is inverted and the chunks of tissue remain fixed to the bottom of the flask and fresh media (e.g., Ham's F12 media, with 10% FBS, penicillin and streptomycin) is added. The flasks are then incubated at 37 degree C. for approximately one week.

At this time, fresh media is added and subsequently changed every several days. After an additional two weeks in culture, a monolayer of fibroblasts emerge. The monolayer is trypsinized and scaled into larger flasks.

pMV-7 (Kirschmeier, P. T. et al., DNA, 7:219-25 (1988)), flanked by the long terminal repeats of the Moloney murine sarcoma virus, is digested with EcoRI and HindIII and subsequently treated with calf intestinal phosphatase. The linear vector is fractionated on agarose gel and purified, using glass beads.

Polynucleotides encoding an albumin fusion protein of the invention can be generated using techniques known in the art amplified using PCR primers which correspond to the 5' and 3' end sequences and optionally having appropriate restriction sites and initiation/stop codons, if necessary. Preferably, the 5' primer contains an EcoRI site and the 3' primer includes a HindIII site. Equal quantities of the Moloney murine sarcoma virus linear backbone and the amplified EcoRI and HindIII fragment are added together, in the presence of T4 DNA ligase. The resulting mixture is maintained under conditions appropriate for ligation of the two fragments. The ligation mixture is then used to transform bacteria HB101, which are then plated onto agar containing kanamycin for the purpose of confirming that the vector has the gene of interest properly inserted.

The amphotropic pA317 or GP+am12 packaging cells are grown in tissue culture to confluent density in Dulbecco's Modified Eagles Medium (DMEM) with 10% calf serum (CS), penicillin and streptomycin. The MSV vector containing the gene is then added to the media and the packaging cells transduced with the vector. The packaging cells now produce infectious viral particles containing the gene (the packaging cells are now referred to as producer cells).

Fresh media is added to the transduced producer cells, and subsequently, the media is harvested from a 10 cm plate of confluent producer cells. The spent media, containing the infectious viral particles, is filtered through a millipore filter to remove detached producer cells and this media is then used to infect fibroblast cells. Media is removed from a sub-confluent plate of fibroblasts and quickly replaced with the media from the producer cells. This media is removed and replaced with fresh media. If the titer of virus is high, then virtually all fibroblasts will be infected and no selection is required. If the titer is very low, then it is necessary to use a retroviral vector that has a selectable marker, such as neo or his. Once the fibroblasts have been efficiently infected, the fibroblasts are analyzed to determine whether the albumin fusion protein is produced.

The engineered fibroblasts are then transplanted onto the host, either alone or after having been grown to confluence on cytodex 3 microcarrier beads.

Example 62

Method of Treatment Using Gene Therapy—In Vivo

Another aspect of the present invention is using in vivo gene therapy methods to treat disorders, diseases and conditions. The gene therapy method relates to the introduction of naked nucleic acid (DNA, RNA, and antisense DNA or RNA) sequences encoding an albumin fusion protein of the invention into an animal. Polynucleotides encoding albumin fusion proteins of the present invention may be operatively linked to (i.e., associated with) a promoter or any other genetic elements necessary for the expression of the polypeptide by the target tissue. Such gene therapy and delivery techniques and methods are known in the art, see, for example, WO90/11092, WO98/11779; U.S. Pat. Nos. 5,693,622, 5,705,151, 5,580,859; Tabata et al., Cardiovasc. Res. 35(3):470-479 (1997); Chao et al., Pharmacol. Res. 35(6):517-522 (1997); Wolff, Neuromuscul. Disord. 7(5):314-318 (1997); Schwartz et al., Gene Ther. 3(5):405-411 (1996); Tsurumi et al., Circulation 94(12):3281-3290 (1996) (incorporated herein by reference).

The polynucleotide constructs may be delivered by any method that delivers injectable materials to the cells of an animal, such as, injection into the interstitial space of tissues (heart, muscle, skin, lung, liver, intestine and the like). The polynucleotide constructs can be delivered in a pharmaceutically acceptable liquid or aqueous carrier.

The term "naked" polynucleotide, DNA or RNA, refers to sequences that are free from any delivery vehicle that acts to assist, promote, or facilitate entry into the cell, including viral sequences, viral particles, liposome formulations, lipofectin or precipitating agents and the like. However, polynucleotides encoding albumin fusion proteins of the present invention may also be delivered in liposome formulations (such as those taught in Felgner P. L. et al. (1995) Ann. NY Acad. Sci. 772:126-139 and Abdallah B. et al. (1995) Biol. Cell 85(1):1-7) which can be prepared by methods well known to those skilled in the art.

The polynucleotide vector constructs used in the gene therapy method are preferably constructs that will not integrate into the host genome nor will they contain sequences that allow for replication. Any strong promoter known to those skilled in the art can be used for driving the expression of DNA. Unlike other gene therapy techniques, one major advantage of introducing naked nucleic acid sequences into target cells is the transitory nature of the polynucleotide synthesis in the cells. Studies have shown that non-replicating DNA sequences can be introduced into cells to provide production of the desired polypeptide for periods of up to six months.

The polynucleotide construct can be delivered to the interstitial space of tissues within an animal, including muscle, skin, brain, lung, liver, spleen, bone marrow, thymus, heart, lymph, blood, bone, cartilage, pancreas, kidney, gall bladder, stomach, intestine, testis, ovary, uterus, rectum, nervous system, eye, gland, and connective tissue. Interstitial space of the tissues comprises the intercellular fluid, mucopolysaccharide matrix among the reticular fibers of organ tissues, elastic fibers in the walls of vessels or chambers, collagen fibers of fibrous tissues, or that same matrix within connective tissue ensheathing muscle cells or in the lacunae of bone. It is similarly the space occupied by the plasma of the circulation and the lymph fluid of the lymphatic channels. Delivery to the interstitial space of muscle tissue is preferred for the reasons discussed below. They may be conveniently delivered by injection into the tissues comprising these cells. They are preferably delivered to and expressed in persistent, non-dividing cells which are differentiated, although delivery and expression may be achieved in non-differentiated or less completely differentiated cells, such as, for example, stem cells of blood or skin fibroblasts. In vivo muscle cells are particularly competent in their ability to take up and express polynucleotides.

For the naked polynucleotide injection, an effective dosage amount of DNA or RNA will be in the range of from about 0.05 g/kg body weight to about 50 mg/kg body weight. Preferably the dosage will be from about 0.005 mg/kg to about 20 mg/kg and more preferably from about 0.05 mg/kg to about 5 mg/kg. Of course, as the artisan of ordinary skill will appreciate, this dosage will vary according to the tissue site of injection. The appropriate and effective dosage of nucleic acid sequence can readily be determined by those of ordinary skill in the art and may depend on the condition being treated and the route of administration. The preferred route of administration is by the parenteral route of injection into the interstitial space of tissues. However, other parenteral routes may also be used, such as, inhalation of an aerosol formulation particularly for delivery to lungs or bronchial tissues, throat or mucous membranes of the nose. In addition, naked polynucleotide constructs can be delivered to arteries during angioplasty by the catheter used in the procedure.

The dose response effects of injected polynucleotide in muscle in vivo is determined as follows. Suitable template DNA for production of mRNA coding for polypeptide of the present invention is prepared in accordance with a standard recombinant DNA methodology. The template DNA, which may be either circular or linear, is either used as naked DNA or complexed with liposomes. The quadriceps muscles of mice are then injected with various amounts of the template DNA.

Five to six week old female and male Balb/C mice are anesthetized by intraperitoneal injection with 0.3 ml of 2.5% Avertin. A 1.5 cm incision is made on the anterior thigh, and the quadriceps muscle is directly visualized. The template DNA is injected in 0.1 ml of carrier in a 1 cc syringe through a 27 gauge needle over one minute, approximately 0.5 cm from the distal insertion site of the muscle into the knee and about 0.2 cm deep. A suture is placed over the injection site for future localization, and the skin is closed with stainless steel clips.

After an appropriate incubation time (e.g., 7 days) muscle extracts are prepared by excising the entire quadriceps. Every fifth 15 um cross-section of the individual quadriceps muscles is histochemically stained for protein expression. A time course for fusion protein expression may be done in a similar fashion except that quadriceps from different mice are harvested at different times. Persistence of DNA in muscle following injection may be determined by Southern blot analysis after preparing total cellular DNA and HIRT supernatants from injected and control mice. The results of the above experimentation in mice can be used to extrapolate proper dosages and other treatment parameters in humans and other animals using naked DNA.

Example 63

Biological Effects of Fusion Proteins of the Invention

Astrocyte and Neuronal Assays

Albumin fusion proteins of the invention can be tested for activity in promoting the survival, neurite outgrowth, or phenotypic differentiation of cortical neuronal cells and for inducing the proliferation of glial fibrillary acidic protein immunopositive cells, astrocytes. The selection of cortical cells for the bioassay is based on the prevalent expression of FGF-1 and FGF-2 in cortical structures and on the previously reported enhancement of cortical neuronal survival resulting from FGF-2 treatment. A thymidine incorporation assay, for example, can be used to elucidate an albumin fusion protein of the invention's activity on these cells.

Moreover, previous reports describing the biological effects of FGF-2 (basic FGF) on cortical or hippocampal neurons in vitro have demonstrated increases in both neuron survival and neurite outgrowth (Walicke et al., "Fibroblast growth factor promotes survival of dissociated hippocampal neurons and enhances neurite extension." *Proc. Natl. Acad. Sci. USA* 83:3012-3016. (1986), assay herein incorporated by reference in its entirety). However, reports from experiments done on PC-12 cells suggest that these two responses are not necessarily synonymous and may depend on not only which FGF is being tested but also on which receptor(s) are expressed on the target cells. Using the primary cortical neuronal culture paradigm, the ability of an albumin fusion protein of the invention to induce neurite outgrowth can be compared to the response achieved with FGF-2 using, for example, a thymidine incorporation assay.

Fibroblast and Endothelial Cell Assays.

Human lung fibroblasts are obtained from Clonetics (San Diego, Calif.) and maintained in growth media from Clonetics. Dermal microvascular endothelial cells are obtained from Cell Applications (San Diego, Calif.). For proliferation assays, the human lung fibroblasts and dermal microvascular endothelial cells can be cultured at 5,000 cells/well in a 96-well plate for one day in growth medium. The cells are then incubated for one day in 0.1% BSA basal medium. After replacing the medium with fresh 0.1% BSA medium, the cells are incubated with the test fusion protein of the invention proteins for 3 days. Alamar Blue (Alamar Biosciences, Sacramento, Calif.) is added to each well to a final concentration of 10%. The cells are incubated for 4 hr. Cell viability is measured by reading in a CytoFluor fluorescence reader. For the $PGE_2$ assays, the human lung fibroblasts are cultured at 5,000 cells/well in a 96-well plate for one day. After a medium change to 0.1% BSA basal medium, the cells are incubated with FGF-2 or fusion protein of the invention with or without IL-1 for 24 hours. The supernatants are collected and assayed for $PGE_2$ by EIA kit (Cayman, Ann Arbor, Mich.). For the IL-6 assays, the human lung fibroblasts are cultured at 5,000 cells/well in a 96-well plate for one day. After a medium change to 0.1% BSA basal medium, the cells are incubated with FGF-2 or with or without an albumin fusion protein of the invention and/or IL-1$\alpha$ for 24 hours. The supernatants are collected and assayed for IL-6 by ELISA kit (Endogen, Cambridge, Mass.). Human lung fibroblasts are cultured with FGF-2 or an albumin fusion protein of the invention for 3 days in basal medium before the addition of Alamar Blue to assess effects on growth of the fibroblasts. FGF-2 should show a stimulation at 10-2500 ng/ml which can be used to compare stimulation with the fusion protein of the invention.

Cell Proliferation Based on [3H]Thymidine Incorporation

The following [3H]Thymidine incorporation assay can be used to measure the effect of a Therapeutic proteins, e.g., growth factor proteins, on the proliferation of cells such as fibroblast cells, epithelial cells or immature muscle cells.

Sub-confluent cultures are arrested in G1 phase by an 18 h incubation in serum-free medium. Therapeutic proteins are then added for 24 h and during the last 4 h, the cultures are labeled with [3H]thymidine, at a final concentration of 0.33 μM (25 Ci/mmol, Amersham, Arlington Heights, Ill.). The incorporated [3H]thymidine is precipitated with ice-cold 10% trichloroacetic acid for 24 h. Subsequently, the cells are rinsed sequentially with ice-cold 10% trichloroacetic acid and then with ice-cold water. Following lysis in 0.5 M NaOH, the lysates and PBS rinses (500 ml) are pooled, and the amount of radioactivity is measured.

Parkinson Models.

The loss of motor function in Parkinson's disease is attributed to a deficiency of striatal dopamine resulting from the degeneration of the nigrostriatal dopaminergic projection neurons. An animal model for Parkinson's that has been extensively characterized involves the systemic administration of 1-methyl-4 phenyl 1,2,3,6-tetrahydropyridine (MPTP). In the CNS, MPTP is taken-up by astrocytes and catabolized by monoamine oxidase B to 1-methyl-4-phenyl pyridine ($MPP^+$) and released. Subsequently, $MPP^+$ is actively accumulated in dopaminergic neurons by the high-affinity reuptake transporter for dopamine. $MPP^+$ is then concentrated in mitochondria by the electrochemical gradient and selectively inhibits nicotidamide adenine disphosphate: ubiquinone oxidoreductionase (complex I), thereby interfering with electron transport and eventually generating oxygen radicals.

It has been demonstrated in tissue culture paradigms that FGF-2 (basic FGF) has trophic activity towards nigral dopaminergic neurons (Ferrari et al., Dev. Biol. 1989). Recently, Dr. Unsicker's group has demonstrated that administering FGF-2 in gel foam implants in the striatum results in the near complete protection of nigral dopaminergic neurons from the toxicity associated with MPTP exposure (Otto and Unsicker, J. Neuroscience, 1990).

Based on the data with FGF-2, an albumin fusion protein of the invention can be evaluated to determine whether it has an action similar to that of FGF-2 in enhancing dopaminergic neuronal survival in vitro and it can also be tested in vivo for protection of dopaminergic neurons in the striatum from the damage associated with MPTP treatment. The potential effect of an albumin fusion protein of the invention is first examined in vitro in a dopaminergic neuronal cell culture paradigm. The cultures are prepared by dissecting the midbrain floor plate from gestation day 14 Wistar rat embryos. The tissue is dissociated with trypsin and seeded at a density of 200,000 cells/$cm^2$ on polyorthinine-laminin coated glass coverslips. The cells are maintained in Dulbecco's Modified Eagle's medium and F12 medium containing hormonal supplements (N1). The cultures are fixed with paraformaldehyde after 8 days in vitro and are processed for tyrosine hydroxylase, a specific marker for dopaminergic neurons, immunohistochemical staining. Dissociated cell cultures are prepared from embryonic rats. The culture medium is changed every third day and the factors are also added at that time.

Since the dopaminergic neurons are isolated from animals at gestation day 14, a developmental time which is past the stage when the dopaminergic precursor cells are proliferating, an increase in the number of tyrosine hydroxylase immunopositive neurons would represent an increase in the number of dopaminergic neurons surviving in vitro. Therefore, if a therapeutic protein of the invention acts to prolong the survival of dopaminergic neurons, it would suggest that the fusion protein may be involved in Parkinson's Disease.

Example 64

Pancreatic Beta-Cell Transplantation Combination Therapy

Transplantation is a common form of treatment of autoimmune disease, especially when the target self tissue has been severely damaged. For example, and not by way of limitation, pancreas transplantation and islet cell transplantation are common treatment options for IDDM (See, e.g., Stewart et al., Journal of Clinical Endocrinology & Metabolism 86 (3): 984-988 (2001); Brunicardi, Transplant. Proc. 28: 2138-40 (1996); Kendall & Robertson, Diabetes Metab. 22: 157-163 (1996); Hamano et al., Kobe J. Med. Sci. 42: 93-104 (1996); Larsen & Stratta, Diabetes Metab. 22: 139-146 (1996); and Kinkhabwala, et al., Am. J. Surg. 171: 516-520 (1996)). As with any transplantation method, transplantation therapies for autoimmune disease patients include treatments to minimize the risk of host rejection of the transplanted tissue. However, autoimmune disease involves the additional, independent risk that the pre-existing host autoimmune response which damaged the original self tissue will exert the same damaging effect on the transplanted tissue. Accordingly, the present invention encompasses methods and compositions for the treatment of autoimmune pancreatic disease using the albumin fusion proteins of the subject invention in combination with immunomodulators/immunosuppressants in individuals undergoing transplantation therapy of the autoimmune disease.

In accordance with the invention, the albumin fusion-based compositions and formulations described above, are administered to prevent and treat damage to the transplanted organ, tissue, or cells resulting from the host individual's autoimmune response initially directed against the original self tissue. Administration may be carried out both prior and subsequent to transplantation in 2 to 4 doses each one week apart.

The following immunomodulators/immunosuppressants including, but not limited to, AI-401, CDP-571 (anti-TNF monoclonal antibody), CG-1088, Diamyd (diabetes vaccine), ICM3 (anti-ICAM-3 monoclonal antibody), linomide (Roquinimex), NBI-6024 (altered peptide ligand), TM-27, VX-740 (HMR-3480), caspase 8 protease inhibitors, thalidomide, hOKT3gammal (Ala-ala) (anti-CD3 monoclonal antibody), Oral Interferon-Alpha, oral *lactobacillus*, and LymphoStat-B™ can be used together with the albumin fusion therapeutics of the subject invention in islet cell or pancreas transplantation.

Example 65

Identification and Cloning of VH and VL Domains

One method to identify and clone VH and VL domains from cell lines expressing a particular antibody is to perform PCR with VH and VL specific primers on cDNA made from the antibody expressing cell lines. Briefly, RNA is isolated from the cell lines and used as a template for RT-PCR designed to amplify the VH and VL domains of the antibodies expressed by the EBV cell lines. Cells may be lysed in the TRIzol® reagent (Life Technologies, Rockville. MD) and extracted with one fifth volume of chloroform. After addition of chloroform, the solution is allowed to incubate at room temperature for 10 minutes, and the centrifuged at 14,000 rpm for 15 minutes at 4° C. in a tabletop centrifuge. The supernatant is collected and RNA is precipitated using an equal volume of isopropanol. Precipitated RNA is pelleted by centrifuging at 14,000 rpm for 15 minutes at 4° C. in a tabletop centrifuge. Following centrifugation, the supernatant is discarded and washed with 75% ethanol. Following washing, the RNA is centrifuged again at 800 rpm for 5 minutes at 4° C. The supernatant is discarded and the pellet allowed to air dry. RNA is the dissolved in DEPC water and heated to 60° C. for 10 minutes. Quantities of RNA can determined using optical density measurements.

cDNA may be synthesized, according to methods well-known in the art, from 1.5-2.5 micrograms of RNA using reverse transciptase and random hexamer primers. cDNA is then used as a template for PCR amplification of VH and VL domains. Primers used to amplify VH and VL genes are shown in Table 7. Typically a PCR reaction makes use of a single 5' primer and a single 3' primer. Sometimes, when the amount of available RNA template is limiting, or for greater efficiency, groups of 5' and/or 3' primers may be used. For example, sometimes all five VH-5' primers and all JH3' primers are used in a single PCR reaction. The PCR reaction is carried out in a 50 microliter volume containing 1×PCR buffer, 2 mM of each dNTP, 0.7 units of High Fidelity Taq polymerse, 5' primer mix, 3' primer mix and 7.5 microliters of cDNA. The 5' and 3' primer mix of both VH and VL can be made by pooling together 22 pmole and 28 pmole, respectively, of each of the individual primers. PCR conditions are: 96° C. for 5 minutes; followed by 25 cycles of 94° C. for 1 minute, 50° C. for 1 minute, and 72° C. for 1 minute; followed by an extension cycle of 72° C. for 10 minutes. After the reaction is completed, sample tubes are stored 4° C.

TABLE 7

Primer Sequences Used to Amplify VH and VL domains.

| Primer name | SEQ ID NO | Primer Sequence (5'-3') |
|---|---|---|
| VH Primers | | |
| Hu VH1-5' | 62 | CAGGTGCAGCTGGTGCAGTCTGG |
| Hu VH2-5' | 63 | CAGGTCAACTTAAGGGAGTCTGG |
| Hu VH3-5' | 64 | GAGGTGCAGCTGGTGGAGTCTGG |
| Hu VH4-5' | 65 | CAGGTGCAGCTGCAGGAGTCGGG |
| Hu VH5-5' | 66 | GAGGTGCAGCTGTTGCAGTCTGC |
| Hu VH6-5' | 67 | CAGGTACAGCTGCAGCAGTCAGG |
| Hu JH1,2-5' | 68 | TGAGGAGACGGTGACCAGGGTGCC |
| Hu JH3-5' | 69 | TGAAGAGACGGTGACCATTGTCCC |
| Hu JH4,5-5' | 70 | TGAGGAGACGGTGACCAGGGTTCC |
| Hu JH6-5' | 71 | TGAGGAGACGGTGACCGTGGTCCC |
| VL Primers | | |
| Hu Vkappa1-5' | 72 | GACATCCAGATGACCCAGTCTCC |
| Hu Vkappa2a-5' | 73 | GATGTTGTGATGACTCAGTCTCC |
| Hu Vkappa2b-5' | 74 | GATATTGTGATGACTCAGTCTCC |
| Hu Vkappa3-5' | 75 | GAAATTGTGTTGACGCAGTCTCC |
| Hu Vkappa4-5' | 76 | GACATCGTGATGACCCAGTCTCC |
| Hu Vkappa5-5' | 77 | GAAACGACACTCACGCAGTCTCC |
| Hu Vkappa6-5' | 78 | GAAATTGTGCTGACTCAGTCTCC |
| Hu Vlambda1-5' | 79 | CAGTCTGTGTTGACGCAGCCGCC |
| Hu Vlambda2-5' | 80 | CAGTCTGCCCTGACTCAGCCTGC |
| Hu Vlambda3-5' | 81 | TCCTATGTGCTGACTCAGCCACC |
| Hu Vlambda3b-5' | 82 | TCTTCTGAGCTGACTCAGGACCC |
| Hu Vlambda4-5' | 83 | CACGTTATACTGACTCAACCGCC |
| Hu Vlambda5-5' | 84 | CAGGCTGTGCTCACTCAGCCGTC |
| Hu Vlambda6-5' | 85 | AATTTTATGCTGACTCAGCCCCA |
| Hu Jkappa1-3' | 86 | ACGTTTGATTTCCACCTTGGTCCC |
| Hu Jkappa2-3' | 87 | ACGTTTGATCTCCAGCTTGGTCCC |
| Hu Jkappa3-3' | 88 | ACGTTTGATATCCACTTTGGTCCC |
| Hu Jkappa4-3' | 89 | ACGTTTGATCTCCACCTTGGTCCC |
| Hu Jkappa5-3' | 90 | ACGTTTAATCTCCAGTCGTGTCCC |
| Hu Jlambda1-3' | 91 | CAGTCTGTGTTGACGCAGCCGCC |
| Hu Jlambda2-3' | 92 | CAGTCTGCCCTGACTCAGCCTGC |
| Hu Jlambda3--3' | 93 | TCCTATGTGCTGACTCAGCCACC |
| Hu Jlambda3b-3' | 94 | TCTTCTGAGCTGACTCAGGACCC |
| Hu Jlambda4-3' | 95 | CACGTTATACTGACTCAACCGCC |

TABLE 7-continued

Primer Sequences Used to Amplify VH and VL domains.

| Primer name | SEQ ID NO | Primer Sequence (5'-3') |
|---|---|---|
| Hu Jlambda5-3' | 96 | CAGGCTGTGCTCACTCAGCCGTC |
| Hu Jlambda6-3' | 97 | AATTTTATGCTGACTCAGCCCCA |

PCR samples are then electrophoresed on a 1.3% agarose gel. DNA bands of the expected sizes (~506 base pairs for VH domains, and 344 base pairs for VL domains) can be cut out of the gel and purified using methods well known in the art. Purified PCR products can be ligated into a PCR cloning vector (TA vector from Invitrogen Inc., Carlsbad, Calif.). Individual cloned PCR products can be isolated after transfection of *E. coli* and blue/white color selection. Cloned PCR products may then be sequenced using methods commonly known in the art.

The PCR bands containing the VH domain and the VL domains can also be used to create full-length Ig expression vectors. VH and VL domains can be cloned into vectors containing the nucleotide sequences of a heavy (e.g., human IgG1 or human IgG4) or light chain (human kappa or human lambda) constant regions such that a complete heavy or light chain molecule could be expressed from these vectors when transfected into an appropriate host cell. Further, when cloned heavy and light chains are both expressed in one cell line (from either one or two vectors), they can assemble into a complete functional antibody molecule that is secreted into the cell culture medium. Methods using polynucleotides encoding VH and VL antibody domain to generate expression vectors that encode complete antibody molecules are well known within the art.

Example 66

Preparation of HA-Cytokine or HA-Growth Factor Fusion Proteins (Such as NGF, BDNFa, BDNFb and BDNFc)

The cDNA for the cytokine or growth factor of interest, such as NGF, can be isolated by a variety of means including from cDNA libraries, by RT-PCR and by PCR using a series of overlapping synthetic oligonucleotide primers, all using standard methods. The nucleotide sequences for all of these proteins are known and available. The cDNA can be tailored at the 5' and 3' ends to generate restriction sites, such that oligonucleotide linkers can be used, for cloning of the cDNA into a vector containing the cDNA for HA. This can be at the N or C-terminus with or without the use of a spacer sequence. NGF (or other cytokine) cDNA is cloned into a vector such as pPPC0005 (FIG. 2), pScCHSA, pScNHSA, or pC4:HSA from which the complete expression cassette is then excised and inserted into the plasmid pSAC35 to allow the expression of the albumin fusion protein in yeast. The albumin fusion protein secreted from the yeast can then be collected and purified from the media and tested for its biological activity. For expression in mammalian cell lines, a similar procedure is adopted except that the expression cassette used employs a mammalian promoter, leader sequence and terminator (See Example 1). This expression cassette is then excised and inserted into a plasmid suitable for the transfection of mammalian cell lines.

Example 67

Preparation of HA-IFN Fusion Proteins (Such as IFNα)

The cDNA for the interferon of interest such as IFNα can be isolated by a variety of means including but not exclusively, from cDNA libraries, by RT-PCR and by PCR using a series of overlapping synthetic oligonucleotide primers, all using standard methods. The nucleotide sequences for interferons, such as IFNα are known and available, for instance, in U.S. Pat. Nos. 5,326,859 and 4,588,585, in EP 32 134, as well as in public databases such as GenBank. The cDNA can be tailored at the 5' and 3' ends to generate restriction sites, such that oligonucleotide linkers can be used to clone the cDNA into a vector containing the cDNA for HA. This can be at the N or C-terminus of the HA sequence, with or without the use of a spacer sequence. The IFNα (or other interferon) cDNA is cloned into a vector such as pPPC0005 (FIG. 2), pScCHSA, pScNHSA, or pC4:HSA from which the complete expression cassette is then excised and inserted into the plasmid pSAC35 to allow the expression of the albumin fusion protein in yeast. The albumin fusion protein secreted from the yeast can then be collected and purified from the media and tested for its biological activity. For expression in mammalian cell lines a similar procedure is adopted except that the expression cassette used employs a mammalian promoter, leader sequence and terminator (See Example 1). This expression cassette is then excised and inserted into a plasmid suitable for the transfection of mammalian cell lines.

Maximum Protein Recovery from Vials

The albumin fusion proteins of the invention have a high degree of stability even when they are packaged at low concentrations. In addition, in spite of the low protein concentration, good fusion-protein recovery is observed even when the aqueous solution includes no other protein added to minimize binding to the vial walls. The recovery of vial-stored HA-IFN solutions was compared with a stock solution. 6 or 30 μg/ml HA-IFN solutions were placed in vials and stored at 4° C. After 48 or 72 hrs a volume originally equivalent to 10 ng of sample was removed and measured in an IFN sandwich ELISA. The estimated values were compared to that of a high concentration stock solution. As shown, there is essentially no loss of the sample in these vials, indicating that addition of exogenous material such as albumin is not necessary to prevent sample loss to the wall of the vials In Vivo Stability and Bioavailability of HA-α-IFN Fusions To determine the in vivo stability and bioavailability of a HA-α-IFN fusion molecule, the purified fusion molecule (from yeast) was administered to monkeys. Pharmaceutical compositions formulated from HA-α-IFN fusions may account for the extended serum half-life and bioavailability. Accordingly, pharmaceutical compositions may be formulated to contain lower dosages of alpha-interferon activity compared to the native alpha-interferon molecule.

Pharmaceutical compositions containing HA-α-IFN fusions may be used to treat or prevent disease in patients with any disease or disease state that can be modulated by the administration of α-IFN. Such diseases include, but are not limited to, hairy cell leukemia, Kaposi's sarcoma, genital and anal warts, chronic hepatitis B, chronic non-A, non-B hepatitis, in particular hepatitis C, hepatitis D, chronic myelogenous leukemia, renal cell carcinoma, bladder carcinoma, ovarian and cervical carcinoma, skin cancers, recurrent respirator papillomatosis, non-Hodgkin's and cutaneous T-cell lymphomas, melanoma, multiple myeloma, AIDS, multiple sclerosis, gliobastoma, etc. (see Interferon Alpha, In: AHFS Drug Information, 1997.

Accordingly, the invention includes pharmaceutical compositions containing a HA-α-IFN fusion protein, polypeptide or peptide formulated with the proper dosage for human administration. The invention also includes methods of treating patients in need of such treatment comprising at least the step of administering a pharmaceutical composition containing at least one HA-α-IFN fusion protein, polypeptide or peptide.

Bifunctional HA-α-IFN fusions

A HA-α-IFN expression vector may be modified to include an insertion for the expression of bifunctional HA-α-IFN fusion proteins. For instance, the cDNA for a second protein of interest may be inserted in frame downstream of the "rHA-IFN" sequence after the double stop codon has been removed or shifted downstream of the coding sequence.

In one version of a bifunctional HA-α-IFN fusion protein, an antibody or fragment against B-lymphocyte stimulator protein (GenBank Acc 4455139) or polypeptide may be fused to one end of the HA component of the fusion molecule. This bifunctional protein is useful for modulating any immune response generated by the A-IFN component of the fusion.

Example 68

Preparation of HA-Hormone Fusion Protein

The cDNA for the hormone of interest can be isolated by a variety of means including but not exclusively, from cDNA libraries, by RT-PCR and by PCR using a series of overlapping synthetic oligonucleotide primers, all using standard methods. The nucleotide sequences for all of these proteins are known and available, for instance, in public databases such as GenBank. The cDNA can be tailored at the 5' and 3' ends to generate restriction sites, such that oligonucleotide linkers can be used, for cloning of the cDNA into a vector containing the cDNA for HA. This can be at the N or C-terminus with or without the use of a spacer sequence. The hormone cDNA is cloned into a vector such as pPPC0005 (FIG. 2), pScCHSA, pScNHSA, or pC4:HSA from which the complete expression cassette is then excised and inserted into the plasmid pSAC35 to allow the expression of the albumin fusion protein in yeast. The albumin fusion protein secreted from the yeast can then be collected and purified from the media and tested for its biological activity. For expression in mammalian cell lines a similar procedure is adopted except that the expression cassette used employs a mammalian promoter, leader sequence and terminator (See Example 1). This expression cassette is then excised and inserted into a plasmid suitable for the transfection of mammalian cell lines.

Example 69

Preparation of HA-Soluble Receptor or HA-Binding Protein Fusion Protein

The cDNA for the soluble receptor or binding protein of interest can be isolated by a variety of means including but not exclusively, from cDNA libraries, by RT-PCR and by PCR using a series of overlapping synthetic oligonucleotide primers, all using standard methods. The nucleotide sequences for all of these proteins are known and available, for instance, in GenBank. The cDNA can be tailored at the 5' and 3' ends to generate restriction sites, such that oligonucleotide linkers can be used, for cloning of the cDNA into a vector containing the cDNA for HA. This can be at the N or C-terminus with or without the use of a spacer sequence. The receptor cDNA is cloned into a vector such as pPPC0005 (FIG. 2), pScCHSA, pScNHSA, or pC4:HSA from which the complete expression cassette is then excised and inserted into the plasmid pSAC35 to allow the expression of the albumin fusion protein in yeast. The albumin fusion protein secreted from the yeast can then be collected and purified from the media and tested for its biological activity. For expression in mammalian cell lines a similar procedure is adopted except that the expression cassette used employs a mammalian promoter, leader sequence and terminator (See Example 1). This expression cassette is then excised and inserted into a plasmid suitable for the transfection of mammalian cell lines.

Example 70

Preparation of HA-Growth Factors

The cDNA for the growth factor of interest can be isolated by a variety of means including but not exclusively, from cDNA libraries, by RT-PCR and by PCR using a series of overlapping synthetic oligonucleotide primers, all using standard methods (see GenBank Acc. No. NP_000609). The cDNA can be tailored at the 5' and 3' ends to generate restriction sites, such that oligonucleotide linkers can be used, for cloning of the cDNA into a vector containing the cDNA for HA. This can be at the N or C-terminus with or without the use of a spacer sequence. The growth factor cDNA is cloned into a vector such as pPPC0005 (FIG. 2), pScCHSA, pScNHSA, or pC4:HSA from which the complete expression cassette is then excised and inserted into the plasmid pSAC35 to allow the expression of the albumin fusion protein in yeast. The albumin fusion protein secreted from the yeast can then be collected and purified from the media and tested for its biological activity. For expression in mammalian cell lines a similar procedure is adopted except that the expression cassette used employs a mammalian promoter, leader sequence and terminator (See Example 1). This expression cassette is then excised and inserted into a plasmid suitable for the transfection of mammalian cell lines.

Example 71

Preparation of HA-Single Chain Antibody Fusion Proteins

Single chain antibodies are produced by several methods including but not limited to: selection from phage libraries, cloning of the variable region of a specific antibody by cloning the cDNA of the antibody and using the flanking constant regions as the primer to clone the variable region, or by synthesizing an oligonucleotide corresponding to the variable region of any specific antibody. The cDNA can be tailored at the 5' and 3' ends to generate restriction sites, such that oligonucleotide linkers can be used, for cloning of the cDNA into a vector containing the cDNA for HA. This can be at the N or C-terminus with or without the use of a spacer sequence. The cell cDNA is cloned into a vector such as pPPC0005 (FIG. 2), pScCHSA, pScNHSA, or pC4:HSA from which the complete expression cassette is then excised and inserted into the plasmid pSAC35 to allow the expression of the albumin fusion protein in yeast.

In fusion molecules of the invention, the $V_H$ and $V_L$ can be linked by one of the following means or a combination thereof: a peptide linker between the C-terminus of the VH and the N-terminus of the $V_L$; a Kex2p protease cleavage site between the $V_H$ and $V_L$ such that the two are cleaved apart upon secretion and then self associate; and cystine residues positioned such that the $V_H$ and $V_L$ can form a disulphide bond between them to link them together. An alternative option would be to place the $V_H$ at the N-terminus of HA or an HA domain fragment and the $V_L$ at the C-terminus of the HA or HA domain fragment.

The albumin fusion protein secreted from the yeast can then be collected and purified from the media and tested for its activity. For expression in mammalian cell lines a similar procedure is adopted except that the expression cassette used employs a mammalian promoter, leader sequence and terminator (See Example 1). This expression cassette is then excised and inserted into a plasmid suitable for the transfection of mammalian cell lines. The antibody produced in this manner can be purified from media and tested for its binding to its antigen using standard immunochemical methods.

Example 72

Preparation of HA-Cell Adhesion Molecule Fusion Proteins

The cDNA for the cell adhesion molecule of interest can be isolated by a variety of means including but not exclusively, from cDNA libraries, by RT-PCR and by PCR using a series of overlapping synthetic oligonucleotide primers, all using standard methods. The nucleotide sequences for the known cell adhesion molecules are known and available, for instance, in GenBank. The cDNA can be tailored at the 5' and 3' ends to generate restriction sites, such that oligonucleotide linkers can be used, for cloning of the cDNA into a vector containing the cDNA for HA. This can be at the N or C-terminus with or without the use of a spacer sequence. The cell adhesion molecule cDNA is cloned into a vector such as pPPC0005 (FIG. 2), pScCHSA, pScNHSA, or pC4:HSA from which the complete expression cassette is then excised and inserted into the plasmid pSAC35 to allow the expression of the albumin fusion protein in yeast. The albumin fusion protein secreted from the yeast can then be collected and purified from the media and tested for its biological activity. For expression in mammalian cell lines a similar procedure is adopted except that the expression cassette used employs a mammalian promoter, leader sequence and terminator (See Example 1). This expression cassette is then excised and inserted into a plasmid suitable for the transfection of mammalian cell lines.

Example 73

Preparation of Inhibitory Factors and Peptides as HA Fusion Proteins (Such as HA-Antiviral, HA-Antibiotic, HA-Enzyme Inhibitor and HA-Anti-Allergic Proteins)

The cDNA for the peptide of interest such as an antibiotic peptide can be isolated by a variety of means including but not exclusively, from cDNA libraries, by RT-PCR and by PCR using a series of overlapping synthetic oligonucleotide primers, all using standard methods. The cDNA can be tailored at the 5' and 3' ends to generate restriction sites, such that oligonucleotide linkers can be used, for cloning of the cDNA into a vector containing the cDNA for HA. This can be at the N or C-terminus with or without the use of a spacer sequence. The peptide cDNA is cloned into a vector such as pPPC0005 (FIG. 2), pScCHSA, pScNHSA, or pC4:HSA from which the complete expression cassette is then excised and inserted into the plasmid pSAC35 to allow the expression of the albumin fusion protein in yeast. The albumin fusion protein secreted from the yeast can then be collected and purified from the media and tested for its biological activity. For expression in mammalian cell lines a similar procedure is adopted except that the expression cassette used employs a mammalian promoter, leader sequence and terminator (See Example 1). This expression cassette is then excised and inserted into a plasmid suitable for the transfection of mammalian cell lines.

Example 74

Preparation of Targeted HA Fusion Proteins

The cDNA for the protein of interest can be isolated from cDNA library or can be made synthetically using several overlapping oligonucleotides using standard molecular biology methods. The appropriate nucleotides can be engineered in the cDNA to form convenient restriction sites and also allow the attachment of the protein cDNA to albumin cDNA. Also a targeting protein or peptide cDNA such as single chain antibody or peptides, such as nuclear localization signals, that can direct proteins inside the cells can be fused to the other end of albumin. The protein of interest and the targeting peptide is cloned into a vector such as pPPC0005 (FIG. 2), pScCHSA, pScNHSA, or pC4:HSA which allows the fusion with albumin cDNA. In this manner both N- and C-terminal end of albumin are fused to other proteins. The fused cDNA is then excised from pPPC0005 and is inserted into a plasmid such as pSAC35 to allow the expression of the albumin fusion protein in yeast. All the above procedures can be performed using standard methods in molecular biology. The albumin fusion protein secreted from yeast can be collected and purified from the media and tested for its biological activity and its targeting activity using appropriate biochemical and biological tests.

Example 75

Preparation of HA-Enzymes Fusions

The cDNA for the enzyme of interest can be isolated by a variety of means including but not exclusively, from cDNA libraries, by RT-PCR and by PCR using a series of overlapping synthetic oligonucleotide primers, all using standard methods. The cDNA can be tailored at the 5' and 3' ends to generate restriction sites, such that oligonucleotide linkers can be used, for cloning of the cDNA into a vector containing the cDNA for HA. This can be at the N or C-terminus with or without the use of a spacer sequence. The enzyme cDNA is cloned into a vector such as pPPC0005 (FIG. 2), pScCHSA, pScNHSA, or pC4:HSA from which the complete expression cassette is then excised and inserted into the plasmid pSAC35 to allow the expression of the albumin fusion protein in yeast. The albumin fusion protein secreted from the yeast can then be collected and purified from the media and tested for its biological activity. For expression in mammalian cell lines a similar procedure is adopted except that the expression cassette used employs a mammalian promoter, leader sequence and terminator (See Example 1). This expression cassette is then excised and inserted into a plasmid suitable for the transfection of mammalian cell lines.

The entire disclosure of each document cited (including patents, patent applications, patent publications, journal articles, abstracts, laboratory manuals, books, or other disclosures) as well as information available through Identifiers specific to databases such as GenBank, GeneSeq, or the CAS Registry, referred to in this application are herein incorporated by reference in their entirety.

---

SEQUENCE LISTING (492 sequences)

SEQ ID NO: 1 - protein, 585 aa, Homo sapiens [sequence omitted]

SEQ ID NO: 2 - DNA, 1782 bp, Homo sapiens
gatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaaatgtgccagtctccaaaaatttggagaaagagctttcaaagcatgggcagtggctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaggattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaactgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcacaaaatgctgcacagagtccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagcttgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatctacatttaaaagcatctcag

SEQ ID NO: 3 - protein, 609 aa, Homo sapiens [sequence omitted]

SEQ ID NO: 4 - protein, 15 aa, Artificial Sequence
  turn (1) to (15): Linker peptide that may be used to join VH and VL domains in an scFv.
GGGGSGGGGSGGGGS

SEQ ID NO: 5 - DNA, 394 bp, Homo sapiens
gcggccgccggatgcaagggttcgaatcccttagctctcattattttttgctttttctcttgaggtcacatgatcgcaaaatggcaaatggcacgtgaagctgtcgatattggggaactgtggtggttggcaaatgactaattaagttagtcaaggcgccatcctcatgaaaactgtgtaacataataaccgaagtgtcgaaaaggtggcaccttgtccaattgaacacgctcgatgaaaaaaataagatatatataaggttaagtaaagcgtctgttagaaaggaagtttttcctttttcttgctctcttgtcttttcatctactatttccttcgtgtaatacagggtcgtcagatacatagatacaattctattacccccatccatacaatg

SEQ ID NO: 6 - protein, 21 aa, Homo sapiens
MKVSVAALSCLMLVTALGSQA

SEQ ID NO: 7 - protein, 17 aa, Artificial Sequence
  Stanniocalcin signal peptide
MLQNSAVLLLLVISASA

SEQ ID NO: 8 - protein, 24 aa, Homo sapiens
MKWVTFISLLFLFSSAYSRGVFRR

SEQ ID NO: 9 - protein, 18 aa, Homo sapiens
MKWVTFISLLFLFSSAYS

SEQ ID NO: 10 - protein, 18 aa, Homo sapiens
MKWVSFISLLFLFSSAYS

SEQ ID NO: 11 - protein, 19 aa, Homo sapiens
MLLQAFLFLLAGFAAKISA

SEQ ID NO: 12 - protein, 86 aa, Homo sapiens
  MISC_FEATURE (84): Xaa equals any one of Glu or Asp
MRFPSIFTAVLAFAASSALAAPVNTTTEDETAQIPAEAVIGYSDLEGDFDVAVLPFSNSTNNGLLFINTTIASIAAKEEGVSLXKR

SEQ ID NO: 13 - protein, 24 aa, Homo sapiens
MKWVSFISLLFLFSSAYSRSLEKR

SEQ ID NO: 14 - protein, 24 aa, Homo sapiens
MKWVSFISLLFLFSSAYSRSLDKR

SEQ ID NO: 15 - protein, 21 aa, Homo sapiens
MNIFYIFLFLLSFVQGSLDKR

SEQ ID NO: 16 - protein, 19 aa, Homo sapiens
MGWSCIILFLVATATGVHS

SEQ ID NO: 17 - protein, 29 aa, Homo sapiens
MERAAPSRRVPLPLLLLGGLALLAAGVDA

SEQ ID NO: 18 - protein, 22 aa, Homo sapiens
MMKTLLLFVGLLLTWESGQVLG

SEQ ID NO: 19 - protein, 21 aa, Homo sapiens
MLPLCLVAALLLAAGPGPSLG

SEQ ID NO: 20 - protein, 24 aa, Homo sapiens
MKWVSFISLLFLFSSAYSRGVFRR

SEQ ID NO: 21 - protein, 18 aa, Artificial Sequence
  MUTAGEN (1) to (18): Variant of the pre-pro-region of the HSA signal sequence
MKWVTFISLLFLFAGVLG

SEQ ID NO: 22 - protein, 18 aa, Artificial Sequence
  MUTAGEN (1) to (18): Variant of the pre-pro-region of the HSA signal sequence
MKWVTFISLLFLFSGVLG

SEQ ID NO: 23 - protein, 18 aa, Artificial Sequence
  MUTAGEN (1) to (18): Variant of the pre-pro-region of the HSA signal sequence
MKWVTFISLLFLFGGVLG

SEQ ID NO: 24 - protein, 18 aa, Homo sapiens
MKWVTFISLLFLFAGVSG

SEQ ID NO: 25 - protein, 18 aa, Homo sapiens
MKWVTFISLLFLFGGVSG

SEQ ID NO: 26 - protein, 18 aa, Artificial Sequence
  MUTAGEN (1) to (18): Variant of HSA native leader
MKWVTFISLLFLFAGVSG

SEQ ID NO: 27 - protein, 18 aa, Artificial Sequence
  MUTAGEN (1) to (18): Variant of HSA native leader
MKWVTFISLLFLFSGVSG

SEQ ID NO: 28 - protein, 18 aa, Artificial Sequence
  MUTAGEN (1) to (18): Variant of HSA native leader
MKWVTFISLLFLFGGVSG

SEQ ID NO: 29 - protein, 23 aa, Artificial Sequence
  MUTAGEN (1) to (23): Variant of HSA native leader
MKWVTFISLLFLFGGVLGDLHKS

SEQ ID NO: 30 - protein, 22 aa, Artificial Sequence
  Synthetic signal peptide
MPTWAWWLFLVLLLALWAPARG

SEQ ID NO: 31 - protein, 17 aa, Homo sapiens
MFKSVVYSILAASLANA

SEQ ID NO: 32 - protein, 29 aa, Homo sapiens
MNIFYIFLFLLSFVQGLEHTHRRGSLDKR

SEQ ID NO: 33 - protein, 23 aa, Homo sapiens
MKLAYSLLLPLAGVSASVINYKR

SEQ ID NO: 34 - protein, 65 aa, Homo sapiens
MKLKTVRSAVLSSLFASQVLGQPIDDTESQTTSVNLMADDTESAFATQTNSGGLDVVGLISMAKR

SEQ ID NO: 35 - protein, 70 aa, Homo sapiens
MKLKTVRSAVLSSLFASQVLGQPIDDTESQTTSVNLMADDTESAFATQTNSGGLDVVGLISMAEEGEPKR

SEQ ID NO: 36 - DNA, 58 bp, Artificial Sequence
  primer used to generate XhoI and ClaI site in pPPC0006
gcctcgagaaaagagatgcacacaagagtgaggttgctcatcgatttaaagatttggg

SEQ ID NO: 37 - DNA, 59 bp, Artificial Sequence
  primer used in generation XhoI and ClaI site in pPPC0006
aatcgatgagcaacctcactcttgtgtgcatctcttttctcgaggctcctggaataagc

SEQ ID NO: 38 - DNA, 24 bp, Artificial Sequence
  primer used in generation XhoI and ClaI site in pPPC0006
tacaaacttaagagtccaattagc

SEQ ID NO: 39 - DNA, 29 bp, Artificial Sequence
  primer used in generation XhoI and ClaI site in pPPC0006
cacttctctagagtggtttcatatgtctt

SEQ ID NO: 40 - DNA, 60 bp, Artificial Sequence
  Misc_Structure (1) to (60): Synthetic oligonucleotide used to alter restriction sites in pPPC0007
aagctgccttaggcttataataaggcgcgccggccggccgtttaaactaagcttaattct

SEQ ID NO: 41 - DNA, 60 bp, Artificial Sequence
  Misc_Structure (1) to (60): Synthetic oligonucleotide used to alter restriction sites in pPPC0007
agaattaagcttagtttaaacggccggccggcgcgccttattataagcctaaggcagctt

SEQ ID NO: 42 - DNA, 32 bp, Artificial Sequence
  (1) to (32): forward primer useful for generation of albumin fusion protein in which the albumin  moiety is N-terminal of the Therapeutic Protein
  misc_feature (18): n equals a,t,g, or c
  misc_feature (19): n equals a,t,g, or c
  misc_feature (20): n equals a,t,g, or c
  misc_feature (21): n equals a,t,g, or c
  misc_feature (22): n equals a,t,g, or c
  misc_feature (23): n equals a,t,g, or c
  misc_feature (24): n equals a,t,g, or c
  misc_feature (25): n equals a,t,g, or c
  misc_feature (26): n equals a,t,g, or c
  misc_feature (27): n equals a,t,g, or c
  misc_feature (28): n equals a,t,g, or c
  misc_feature (29): n equals a,t,g, or c
  misc_feature (30): n equals a,t,g, or c
  misc_feature (31): n equals a,t,g, or c
  misc_feature (32): n equals a,t,g, or c
aagctgccttaggcttannnnnnnnnnnnnnn

SEQ ID NO: 43 - DNA, 51 bp, Artificial Sequence
  reverse primer useful for generation of albumin fusion protein in which the albumin  moiety is N-terminal of the Therapeutic Protein
  misc_feature (37): n equals a,t,g, or c
  misc_feature (38): n equals a,t,g, or c
  misc_feature (39): n equals a,t,g, or c
  misc_feature (40): n equals a,t,g, or c
  misc_feature (41): n equals a,t,g, or c
  misc_feature (42): n equals a,t,g, or c
  misc_feature (43): n equals a,t,g, or c
  misc_feature (44): n equals a,t,g, or c
  misc_feature (45): n equals a,t,g, or c
  misc_feature (46): n equals a,t,g, or c
  misc_feature (47): n equals a,t,g, or c
  misc_feature (48): n equals a,t,g, or c
  misc_feature (49): n equals a,t,g, or c
  misc_feature (50): n equals a,t,g, or c
  misc_feature (51): n equals a,t,g, or c
gcgcgcgtttaaacggccggccggcgcgccttattannnnnnnnnnnnnnn

SEQ ID NO: 44 - protein, 4 aa, Homo sapiens
LDKR

SEQ ID NO: 45 - protein, 4 aa, Homo sapiens
LEKR

SEQ ID NO: 46 - DNA, 33 bp, Artificial Sequence
  forward primer useful for generation of albumin fusion protein in which the albumin  moiety is c-terminal of the Therapeutic Protein
  misc_feature (19): n equals a,t,g, or c
  misc_feature (20): n equals a,t,g, or c
  misc_feature (21): n equals a,t,g, or c
  misc_feature (22): n equals a,t,g, or c
  misc_feature (23): n equals a,t,g, or c
  misc_feature (24): n equals a,t,g, or c
  misc_feature (25): n equals a,t,g, or c
  misc_feature (26): n equals a,t,g, or c
  misc_feature (27): n equals a,t,g, or c
  misc_feature (28): n equals a,t,g, or c
  misc_feature (29): n equals a,t,g, or c
  misc_feature (30): n equals a,t,g, or c
  misc_feature (31): n equals a,t,g, or c
  misc_feature (32): n equals a,t,g, or c
  misc_feature (33): n equals a,t,g, or c
aggagcgtcgacaaaagannnnnnnnnnnnnnn

SEQ ID NO: 47 - DNA, 52 bp, Artificial Sequence
  reverse primer useful for generation of albumin fusion protein in which the albumin  moiety is c-terminal of the Therapeutic Protein
  misc_feature (38): n equals a,t,g, or c
  misc_feature (39): n equals a,t,g, or c
  misc_feature (40): n equals a,t,g, or c
  misc_feature (41): n equals a,t,g, or c
  misc_feature (42): n equals a,t,g, or c
  misc_feature (43): n equals a,t,g, or c
  misc_feature (44): n equals a,t,g, or c
  misc_feature (45): n equals a,t,g, or c
  misc_feature (46): n equals a,t,g, or c
  misc_feature (47): n equals a,t,g, or c
  misc_feature (48): n equals a,t,g, or c
  misc_feature (49): n equals a,t,g, or c
  misc_feature (50): n equals a,t,g, or c
  misc_feature (51): n equals a,t,g, or c
  misc_feature (52): n equals a,t,g, or c
ctttaaatcgatgagcaacctcactcttgtgtgcatcnnnnnnnnnnnnnnn

SEQ ID NO: 48 - protein, 9 aa, Homo sapiens
DAHKSEVAH

SEQ ID NO: 49 - DNA, 11 bp, Artificial Sequence
  misc_feature (1) to (11): Synthetic Kozak Sequence
ccgccaccatg

SEQ ID NO: 50 - DNA, 46 bp, Artificial Sequence
  forward primer useful for inserting Therapeutic protein into pC4:HSA vector
  misc_feature (29): n equals a,t,g, or c
  misc_feature (30): n equals a,t,g, or c
  misc_feature (31): n equals a,t,g, or c
  misc_feature (32): n equals a,t,g, or c
  misc_feature (33): n equals a,t,g, or c
  misc_feature (34): n equals a,t,g, or c
  misc_feature (35): n equals a,t,g, or c
  misc_feature (36): n equals a,t,g, or c
  misc_feature (37): n equals a,t,g, or c
  misc_feature (38): n equals a,t,g, or c
  misc_feature (39): n equals a,t,g, or c
  misc_feature (40): n equals a,t,g, or c
  misc_feature (41): n equals a,t,g, or c
  misc_feature (42): n equals a,t,g, or c
  misc_feature (43): n equals a,t,g, or c
  misc_feature (44): n equals a,t,g, or c
  misc_feature (45): n equals a,t,g, or c
  misc_feature (46): n equals a,t,g, or c
ccgccgctcgaggggtgtgtttcgtcgannnnnnnnnnnnnnnnnn

SEQ ID NO: 51 - DNA, 55 bp, Artificial Sequence
  reverse primer useful for inserting Therapeutic protein into pC4:HSA vector
  misc_feature (38): n equals a,t,g, or c
  misc_feature (39): n equals a,t,g, or c
  misc_feature (40): n equals a,t,g, or c
  misc_feature (41): n equals a,t,g, or c
  misc_feature (42): n equals a,t,g, or c
  misc_feature (43): n equals a,t,g, or c
  misc_feature (44): n equals a,t,g, or c
  misc_feature (45): n equals a,t,g, or c
  misc_feature (46): n equals a,t,g, or c
  misc_feature (47): n equals a,t,g, or c
  misc_feature (48): n equals a,t,g, or c
  misc_feature (49): n equals a,t,g, or c
  misc_feature (50): n equals a,t,g, or c
  misc_feature (51): n equals a,t,g, or c
  misc_feature (52): n equals a,t,g, or c
  misc_feature (53): n equals a,t,g, or c
  misc_feature (54): n equals a,t,g, or c
  misc_feature (55): n equals a,t,g, or c
agtcccatcgatgagcaacctcactcttgtgtgcatcnnnnnnnnnnnnnnnnnn

SEQ ID NO: 52 - DNA, 733 bp, Homo sapiens
gggatccggagcccaaatcttctgacaaaactcacacatgcccaccgtgcccagcacctgaattcgagggtgcaccgtcagtcttcctcttccccccaaaacccaaggacaccctcatgatctcccggactcctgaggtcacatgcgtggtggtggacgtaagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaacccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagtgcgacggccgcgactctagaggat

SEQ ID NO: 53 - protein, 5 aa, Homo sapiens
  MISC_FEATURE (3): Xaa equals any of the twenty naturally ocurring L-amino acids
WSXWS

SEQ ID NO: 54 - DNA, 86 bp, Artificial Sequence
  Synthetic sequence with 4 tandem copies of the GAS binding site found in the IRF1 promoter (Rothman et al., Immunity 1:457-468 (1994)), 18 nucleotides complementary to the SV40 early promoter, and a Xho I restriction site.
gcgcctcgagatttccccgaaatctagatttccccgaaatgatttccccgaaatgatttccccgaaatatctgccatctcaattag

SEQ ID NO: 55 - DNA, 27 bp, Artificial Sequence
  Synthetic sequence complementary to the SV40 promter; includes a Hind III restriction site.
gcggcaagctttttgcaaagcctaggc

SEQ ID NO: 56 - DNA, 271 bp, Artificial Sequence
  Protein_Bind (1) to (271): Synthetic promoter sequence for use in biological assays; includes GAS binding sites found in the IRF1 promoter
ctcgagatttccccgaaatctagatttccccgaaatgatttccccgaaatgatttccccgaaatatctgccatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctt

SEQ ID NO: 57 - DNA, 32 bp, Artificial Sequence
  Synthetic primer complementary to human genomic EGR-1 promoter sequence; includes a Xho I restriction site.
gcgctcgagggatgacagcgatagaaccccgg

SEQ ID NO: 58 - DNA, 31 bp, Artificial Sequence
  Synthetic primer complementary to human genomic EGR-1 promoter sequence; includes a Hind III restriction site.
gcgaagcttcgcgactccccggatccgcctc

SEQ ID NO: 59 - DNA, 12 bp, Homo sapiens
ggggactttccc

SEQ ID NO: 60 - DNA, 73 bp, Artificial Sequence
  Synthetic primer with 4 tandem copies of the NF-KB binding site (GGGGACTTTCCC), 18 nucleotides complementary to the 5' end of the SV40 early promoter sequence, and a XhoI restriction site.
gcggcctcgaggggactttcccggggactttccggggactttccgggactttccatcctgccatctcaattag

SEQ ID NO: 61 - DNA, 256 bp, Artificial Sequence
  Protein_Bind (1) to (256): Synthetic promoter sequence for use in biological assays; includes NF-KB binding sites.
ctcgaggggactttcccggggactttccggggactttccgggactttccatctgccatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctt

SEQ ID NO: 62 - DNA, 23 bp, Artificial Sequence
  Degenerate VH forward primer useful for amplifying human VH domains
caggtgcagctggtgcagtctgg

SEQ ID NO: 63 - DNA, 23 bp, Artificial Sequence
  Degenerate VH forward primer useful for amplifying human VH domains
caggtcaacttaagggagtctgg

SEQ ID NO: 64 - DNA, 23 bp, Artificial Sequence
  Degenerate VH forward primer useful for amplifying human VH domains
gaggtgcagctggtggagtctgg

SEQ ID NO: 65 - DNA, 23 bp, Artificial Sequence
  Degenerate VH forward primer useful for amplifying human VH domains
caggtgcagctgcaggagtcggg

SEQ ID NO: 66 - DNA, 23 bp, Artificial Sequence
  Degenerate VH forward primer useful for amplifying human VH domains
gaggtgcagctgttgcagtctgc

SEQ ID NO: 67 - DNA, 23 bp, Artificial Sequence
  Degenerate VH forward primer useful for amplifying human VH domains
caggtacagctgcagcagtcagg

SEQ ID NO: 68 - DNA, 24 bp, Artificial Sequence
  Degenerate JH reverse primer useful for amplifying human VH domains
tgaggagacggtgaccagggtgcc

SEQ ID NO: 69 - DNA, 24 bp, Artificial Sequence
  Degenerate JH reverse primer useful for amplifying human VH domains
tgaagagacggtgaccattgtccc

SEQ ID NO: 70 - DNA, 24 bp, Artificial Sequence
  Degenerate JH reverse primer useful for amplifying human VH domains
tgaggagacggtgaccagggttcc

SEQ ID NO: 71 - DNA, 24 bp, Artificial Sequence
  Degenerate JH reverse primer useful for amplifying human VH domains
tgaggagacggtgaccgtggtccc

SEQ ID NO: 72 - DNA, 23 bp, Artificial Sequence
  Degenerate Vkappa forward primer useful for amplifying human VL domains
gacatccagatgacccagtctcc

SEQ ID NO: 73 - DNA, 23 bp, Artificial Sequence
  Degenerate Vkappa forward primer useful for amplifying human VL domains
gatgttgtgatgactcagtctcc

SEQ ID NO: 74 - DNA, 23 bp, Artificial Sequence
  Degenerate Vkappa forward primer useful for amplifying human VL domains
gatattgtgatgactcagtctcc

SEQ ID NO: 75 - DNA, 23 bp, Artificial Sequence
  Degenerate Vkappa forward primer useful for amplifying human VL domains
gaaattgtgttgacgcagtctcc

SEQ ID NO: 76 - DNA, 23 bp, Artificial Sequence
  Degenerate Vkappa forward primer useful for amplifying human VL domains
gacatcgtgatgacccagtctcc

SEQ ID NO: 77 - DNA, 23 bp, Artificial Sequence
  Degenerate Vkappa forward primer useful for amplifying human VL domains
gaaacgacactcacgcagtctcc

SEQ ID NO: 78 - DNA, 23 bp, Artificial Sequence
  Degenerate Vkappa forward primer useful for amplifying human VL domains
gaaattgtgctgactcagtctcc

SEQ ID NO: 79 - DNA, 23 bp, Artificial Sequence
  Degenerate Vlambda forward primer useful for amplifying human VL domains
cagtctgtgttgacgcagccgcc

SEQ ID NO: 80 - DNA, 23 bp, Artificial Sequence
  Degenerate Vlambda forward primer useful for amplifying human VL domains
cagtctgccctgactcagcctgc

SEQ ID NO: 81 - DNA, 23 bp, Artificial Sequence
  Degenerate Vlambda forward primer useful for amplifying human VL domains
tcctatgtgctgactcagccacc

SEQ ID NO: 82 - DNA, 23 bp, Artificial Sequence
  Degenerate Vlambda forward primer useful for amplifying human VL domains
tcttctgagctgactcaggaccc

SEQ ID NO: 83 - DNA, 23 bp, Artificial Sequence
  Degenerate Vlambda forward primer useful for amplifying human VL domains
cacgttatactgactcaaccgcc

SEQ ID NO: 84 - DNA, 23 bp, Artificial Sequence
  Degenerate Vlambda forward primer useful for amplifying human VL domains
caggctgtgctcactcagccgtc

SEQ ID NO: 85 - DNA, 23 bp, Artificial Sequence
  Degenerate Vlambda forward primer useful for amplifying human VL domains
aattttatgctgactcagcccca

SEQ ID NO: 86 - DNA, 24 bp, Artificial Sequence
  Degenerate Jkappa reverse primer useful for amplifying human VL domains
acgtttgatttccaccttggtccc

SEQ ID NO: 87 - DNA, 24 bp, Artificial Sequence
  Degenerate Jkappa reverse primer useful for amplifying human VL domains
acgtttgatctccagcttggtccc

SEQ ID NO: 88 - DNA, 24 bp, Artificial Sequence
  Degenerate Jkappa reverse primer useful for amplifying human VL domains
acgtttgatatccactttggtccc

SEQ ID NO: 89 - DNA, 24 bp, Artificial Sequence
  Degenerate Jkappa reverse primer useful for amplifying human VL domains
acgtttgatctccaccttggtccc

SEQ ID NO: 90 - DNA, 24 bp, Artificial Sequence
  Degenerate Jkappa reverse primer useful for amplifying human VL domains
acgtttaatctccagtcgtgtccc

SEQ ID NO: 91 - DNA, 23 bp, Artificial Sequence
  Degenerate Jlambda reverse primer useful for amplifying human VL domains
cagtctgtgttgacgcagccgcc

SEQ ID NO: 92 - DNA, 23 bp, Artificial Sequence
  Degenerate Jlambda reverse primer useful for amplifying human VL domains
cagtctgccctgactcagcctgc

SEQ ID NO: 93 - DNA, 23 bp, Artificial Sequence
  Degenerate Jlambda reverse primer useful for amplifying human VL domains
tcctatgtgctgactcagccacc

SEQ ID NO: 94 - DNA, 23 bp, Artificial Sequence
  Degenerate Jlambda reverse primer useful for amplifying human VL domains
tcttctgagctgactcaggaccc

SEQ ID NO: 95 - DNA, 23 bp, Artificial Sequence
  Degenerate Jlambda reverse primer useful for amplifying human VL domains
cacgttatactgactcaaccgcc

SEQ ID NO: 96 - DNA, 23 bp, Artificial Sequence
  Degenerate Jlambda reverse primer useful for amplifying human VL domains
caggctgtgctcactcagccgtc

SEQ ID NO: 97 - DNA, 23 bp, Artificial Sequence
  Degenerate Jlambda reverse primer useful for amplifying human VL domains
aattttatgctgactcagcccca

SEQ ID NO: 98 - protein, 23 aa, Artificial Sequence
  Synthetic signal peptide
MRPTWAWWLFLVLLLALWAPARG

SEQ ID NO: 99 - protein, 21 aa, Homo sapiens
MWWRLWWLLLLLLLLWPMVWA

SEQ ID NO: 100 - protein, 24 aa, Homo sapiens
MKWVSFISLLFLFSSAYSGSLDKR

SEQ ID NO: 101 - DNA, 1497 bp, Hypocrea jecorina
tctagagttgtgaagtcggtaatcccgctgtatagtaatacgagtcgcatctaaatactccgaagctgctgcgaacccggagaatcgagatgtgctggaaagcttctagcgagcggctaaattagcatgaaaggctatgagaaattctggagacggcttgttgaatcatggcgttccattcttcgacaagcaaagcgttccgtcgcagtagcaggcactcattcccgaaaaaactcggagattcctaagtagcgatggaaccggaataatataataggcaatacattgagttgcctcgacggttgcaatgcaggggtactgagcttggacataactgttccgtaccccacctcttctcaacctttggcgtttccctgattcagcgtacccgtacaagtcgtaatcactattaacccagactgaccggacgtgttttgcccttcatttggagaaataatgtcattgcgatgtgtaatttgcctgcttgaccgactggggctgttcgaagcccgaatgtaggattgttatccgaactctgctcgtagaggcatgttgtgaatctgtgtcgggcaggacacgcctcgaaggttcacggcaagggaaaccaccgatagcagtgtctagtagcaacctgtaaagccgcaatgcagcatcactggaaaatacaaaccaatggctaaaagtacataagttaatgcctaaagaagtcatataccagcggctaataattgtacaatcaagtggctaaacgtaccgtaatttgccaacggcttgtggggttgcagaagcaacggcaaagccccacttccccacgtttgtttcttcactcagtccaatctcagctggtgatcccccaattgggtcgcttgtttgttccggtgaagtgaaagaagacagaggtaagaatgtctgactcggagcgttttgcatacaaccaagggcagtgatggaagacagtgaaatgttgacattcaaggagtatttagccagggatgcttgagtgtatcgtgtaaggaggtttgtctgccgatacgacgaatactgtatagtcacttctggtgaagtggtccatattgaaatgtaagtcggcactgaacaggcaaaagattgagttgaaactgcctaagatctcgggccctcgggccttcggcctttgggtgtacatgtttgtgctccgggcaaatgcaaagtgtggtaggatcgaacacactgctgcctttaccaagcagctgagggtatgtgataggcaaatgttcaggggccactgcatggtttcgaatagaaagagaagcttagccaagaacaatagccgataaagatagcctcattaaacggaatgagctagtaggcaaagtcagcgaatgtgtatatataaaggttcgaggtccgtgcctccctcatgctctccccatctactcatcaactcagatcctccaggagacttgtacaccatcttttgaggcacagaaacccaatagtcaaccgcggactggcatc

SEQ ID NO: 102 - DNA, 366 bp, Aspergillus nidulans
agatctggttcctgagtacatctaccgatgcgcctcgatccccctcttagccgcatgagattcctaccatttatgtcctatcgttcagggtcctatttggaccgctagaaatagactctgctcgatttgtttccattattcacgcaattacgatagtatttggctcttttcgtttggcccaggtcaattcgggtaagacgcgatcacgccattgtggccgccggcgttgtgctgctgctattccccgcatataaacaacccctccaccagttcgttgggctttgcgaatgctgtactctatttcaagttgtcaaaagagaggattcaaaaaattataccccagatatcaaagatatcaaagccatc

SEQ ID NO: 103 - DNA, 1646 bp, Hypocrea jecorina
tctagagttgtgaagtcggtaatcccgctgtatagtaatacgagtcgcatctaaatactccgaagctgctgcgaacccggagaatcgagatgtgctggaaagcttctagcgagcggctaaattagcatgaaaggctatgagaaattctggagacggcttgttgaatcatggcgttccattcttcgacaagcaaagcgttccgtcgcagtagcaggcactcattcccgaaaaaactcggagattcctaagtagcgatggaaccggaataatataataggcaatacattgagttgcctcgacggttgcaatgcaggggtactgagcttggacataactgttccgtaccccacctcttctcaacctttggcgtttccctgattcagcgtacccgtacaagtcgtaatcactattaacccagactgaccggacgtgttttgcccttcatttggagaaataatgtcattgcgatgtgtaatttgcctgcttgaccgactggggctgttcgaagcccgaatgtaggattgttatccgaactctgctcgtagaggcatgttgtgaatctgtgtcgggcaggacacgcctcgaaggttcacggcaagggaaaccaccgatagcagtgtctagtagcaacctgtaaagccgcaatgcagcatcactggaaaatacaaaccaatggctaaaagtacataagttaatgcctaaagaagtcatataccagcggctaataattgtacaatcaagtggctaaacgtaccgtaatttgccaacggcttgtggggttgcagaagcaacggcaaagccccacttccccacgtttgtttcttcactcagtccaatctcagctggtgatcccccaattgggtcgcttgtttgttccggtgaagtgaaagaagacagaggtaagaatgtctgactcggagcgttttgcatacaaccaagggcagtgatggaagacagtgaaatgttgacattcaaggagtatttagccagggatgcttgagtgtatcgtgtaaggaggtttgtctgccgatacgacgaatactgtatagtcacttctggtgaagtggtccatattgaaatgtaagtcggcactgaacaggcaaaagattgagttgaaactgcctaagatctcgggccctcgggccttcggcctttgggtgtacatgtttgtgctccgggcaaatgcaaagtgtggtaggatcgaacacactgctgcctttaccaagcagctgagggtatgtgataggcaaatgttcaggggccactgcatggtttcgaatagaaagagaagcttagcctgcagcctcttatcgagaaagaaattaccgtcgctcgtgatttgtttgcaaaaagaacaaaactgaaaaaacccagacacgctcgacttcctgtcttcctattgattgcagcttccaatttcgtcacacaacaaggtcctagcttagccaagaacaatagccgataaagatagcctcattaaacggaatgagctagtaggcaaagtcagcgaatgtgtatatataaaggttcgaggtccgtgcctccctcatgctctccccatctactcatcaactcagatcctccaggagacttgtacaccatcttttgaggcacagaaacccaatagtcaaccgcggactggcatc

SEQ ID NO: 104 - DNA, 516 bp, Aspergillus nidulans
agatctggttcctgagtacatctaccgatgcgcctcgatccccctcttagccgcatgagattcctaccatttatgtcctatcgttcagggtcctatttggaccgctagaaatagactctgctcgatttgtttccattattcacgcaattacgatagtatttggctcttttcgtttggcccaggtcaattcgggtaagacgcgatcacgccattgtggccgccggcgctgcagcctcttatcgagaaagaaattaccgtcgctcgtgatttgtttgcaaaaagaacaaaactgaaaaaacccagacacgctcgacttcctgtcttcctattgattgcagcttccaatttcgtcacacaacaaggtcctacgccggcgttgtgctgctgctattccccgcatataaacaacccctccaccagttcgttgggctttgcgaatgctgtactctatttcaagttgtcaaaagagaggattcaaaaaattataccccagatatcaaagatatcaaagccatc

SEQ ID NO: 105 - DNA, 117 bp, Homo sapiens
cactcccaaggtaccttcacctccgactactccaagtacttggactccagaagagcccaagacttcgtgcaatggttgatgaacaccaagagaaacagaaataacatcgcctagtaa

SEQ ID NO: 106 - DNA, 117 bp, Homo sapiens; identical to SEQ ID NO: 105

SEQ ID NO: 107 - DNA, 117 bp, Homo sapiens; identical to SEQ ID NO: 105

SEQ ID NO: 108 - DNA, 117 bp, Homo sapiens; identical to SEQ ID NO: 105

SEQ ID NO: 109 - DNA, 108 bp, Homo sapiens
cactcccaaggtaccttcacctccgactactccaagtacttggactccagaagagcccaagacttcgtgcaatggttgatgaacaccaagagaaacagaaataacatc

SEQ ID NO: 110 - DNA, 111 bp, Homo sapiens
gcctgtgacactgccacctgtgtgactcatcggctggcaggcttgctgagcagatcagggggtgtggtgaagaacaactttgtgcccaccaatgtgggttccaaagccttt

SEQ ID NO: 111 - DNA, 111 bp, Homo sapiens; identical to SEQ ID NO: 110

SEQ ID NO: 112 - DNA, 111 bp, Homo sapiens; identical to SEQ ID NO: 110

SEQ ID NO: 113 - DNA, 111 bp, Homo sapiens; identical to SEQ ID NO: 110

SEQ ID NO: 114 - DNA, 462 bp, Homo sapiens
atgggaaaaatcagcagtcttccaacccaattatttaagtgctgcttttgtgatttcttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaaggaagtacatttgaagaacgcaagtagagggagtgcaggaaacaagaactacaggatgtag

SEQ ID NO: 115 - DNA, 462 bp, Homo sapiens; identical to SEQ ID NO: 114

SEQ ID NO: 116 - DNA, 108 bp, Homo sapiens; identical to SEQ ID NO: 109

SEQ ID NO: 117 - DNA, 1809 bp, Homo sapiens
atgcatagcaaagtcacaatcatatgcatcagatttctcttttggtttcttttgctctgcatgcttattgggaagtcacatactgaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagtgcaggagcagcttcagttagcctgcatttgctttctcctggaagccattcattgttcaccagagccattctgcaaagtggatcctttaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgtcagtaaactttggtccgaccgtggatggtgattttctcactgacatgccagacatattacttgaacttggacaatttaaaaaaacccagattttggtgggtgttaataaagatgaagggacagcttttttagtctatggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaa

SEQ ID NO: 118 - DNA, 1809 bp, Homo sapiens; identical to SEQ ID NO: 117

SEQ ID NO: 119 - protein, 641 aa, Homo sapiens
MLLQAFLFLLAGFAAKISAHSQGTFTSDYSKYLDSRRAQDFVQWLMNTKRNRNNIADAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 120 - protein, 691 aa, Homo sapiens
MLLQAFLFLLAGFAAKISAIKPEAPGEDASPEELNRYYASLRHYLNLVTRQRYDAHKSEVAHRFKDLGEDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHSQGTFTSDYSKYLDSRRAQDFVQWLMNTKRNRNNIA

SEQ ID NO: 121 - protein, 646 aa, Homo sapiens
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHSQGTFTSDYSKYLDSRRAQDFVQWLMNTKRNRNNIA

SEQ ID NO: 122 - protein, 646 aa, Homo sapiens; identical to SEQ ID NO: 121

SEQ ID NO: 123 - protein, 645 aa, Homo sapiens
MRPTWAWWLFLVLLLALWAPARGHSQGTFTSDYSKYLDSRRAQDFVQWLMNTKRNRNNIADAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 124 - protein, 639 aa, Homo sapiens
MKWVSFISLLFLFSSAYSRSLDKRVTHRLAGLLSRSGGVVKNNFVPTNVGSKAFDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 125 - protein, 639 aa, Homo sapiens
MKWVSFISLLFLFSSAYSRSLDKRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLVTHRLAGLLSRSGGVVKNNFVPTNVGSKAF

SEQ ID NO: 126 - protein, 635 aa, Homo sapiens
MKWVSFISLLFLFSSAYSRSLDKRLAGLLSRSGGVVKNNFVPTNVGSKAFDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 127 - protein, 635 aa, Homo sapiens
MKWVSFISLLFLFSSAYSRSLDKRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLLAGLLSRSGGVVKNNFVPTNVGSKAF

SEQ ID NO: 128 - protein, 714 aa, Homo sapiens [sequence omitted]

SEQ ID NO: 129 - protein, 714 aa, Homo sapiens
MKWVSFISLLFLFSSAYSRSLDKRGPETLCGAELVDALQFVCGDRGFYFNKPTGYGSSSRRAPQTGIVDECCFRSCDLRRLEMYCAPLKPAKSARSVRAQRHTDMPKTQKEVHLKNASRGSAGNKNYRMDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 130 - protein, 682 aa, Homo sapiens
MRPTWAWWLFLVLLLALWAPARGHSQGTFTSDYSKYLDSRRAQDFVQWLMNTKRNRNNIAHSQGTFTSDYSKYLDSRRAQDFVQWLMNTKRNRNNIADAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 131 - protein, 1138 aa, Homo sapiens
MKWVSFISLLFLFSSAYSRSLDKREDDIIIATKNGKVRGMQLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESAGAASVSLHLLSPGSHSLFTRAILQSGSFNAPWAVTSLYEARNRTLNLAKLTGCSRENETEIIKCLRNKDPQEILLNEAFVVPYGTPLSVNFGPTVDGDFLTDMPDILLELGQFKKTQILVGVNKDEGTWFLVAGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDQYTKAEEILSRSIVKRWANFAKYGNPQETQNQSTSWPVFKSTEQKYLTLNTESTRIMTKLRAQQCRFWTSFFPKVDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 132 - protein, 1137 aa, Homo sapiens
MRPTWAWWLFLVLLLALWAPARGEDDIIIATKNGKVRGMQLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESAGAASVSLHLLSPGSHSLFTRAILQSGSFNAPWAVTSLYEARNRTLNLAKLTGCSRENETEIIKCLRNKDPQEILLNEAFVVPYGTPLSVNFGPTVDGDFLTDMPDILLELGQFKKTQILVGVNKDEGTWFLVAGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDQYTKAEEILSRSIVKRWANFAKYGNPQETQNQSTSWPVFKSTEQKYLTLNTESTRIMTKLRAQQCRFWTSFFPKVDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 133 - protein, 37 aa, Homo sapiens
HSQGTFTSDYSKYLDSRRAQDFVQWLMNTKRNRNNIA

SEQ ID NO: 134 - protein, 37 aa, Homo sapiens; identical to SEQ ID NO: 133

SEQ ID NO: 135 - protein, 37 aa, Homo sapiens; identical to SEQ ID NO: 133

SEQ ID NO: 136 - protein, 37 aa, Homo sapiens; identical to SEQ ID NO: 133

SEQ ID NO: 137 - protein, 36 aa, Homo sapiens
HSQGTFTSDYSKYLDSRRAQDFVQWLMNTKRNRNNI

SEQ ID NO: 138 - protein, 37 aa, Homo sapiens
ACDTATCVTHRLAGLLSRSGGVVKNNFVPTNVGSKAF

SEQ ID NO: 139 - protein, 37 aa, Homo sapiens; identical to SEQ ID NO: 138

SEQ ID NO: 140 - protein, 37 aa, Homo sapiens; identical to SEQ ID NO: 138

SEQ ID NO: 141 - protein, 37 aa, Homo sapiens; identical to SEQ ID NO: 138

SEQ ID NO: 142 - protein, 153 aa, Homo sapiens
MGKISSLPTQLFKCCFCDFLKVKMHTMSSSHLFYLALCLLTFTSSATAGPETLCGAELVDALQFVCGDRGFYFNKPTGYGSSSRRAPQTGIVDECCFRSCDLRRLEMYCAPLKPAKSARSVRAQRHTDMPKTQKEVHLKNASRGSAGNKNYRM

SEQ ID NO: 143 - protein, 153 aa, Homo sapiens; identical to SEQ ID NO: 142

SEQ ID NO: 144 - protein, 36 aa, Homo sapiens; identical to SEQ ID NO: 137

SEQ ID NO: 145 - protein, 602 aa, Homo sapiens
MHSKVTIICIRFLFWFLLLCMLIGKSHTEDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESAGAASVSLHLLSPGSHSLFTRAILQSGSFNAPWAVTSLYEARNRTLNLAKLTGCSRENETEIIKCLRNKDPQEILLNEAFVVPYGTPLSVNFGPTVDGDFLTDMPDILLELGQFKKTQILVGVNKDEGTAFLVYGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 146 - protein, 602 aa, Homo sapiens; identical to SEQ ID NO: 145

SEQ ID NO: 147 - DNA, 46 bp, Homo sapiens
caagctgccttaggcttacactcccaaggtaccttcacctccgact

SEQ ID NO: 148 - DNA, 59 bp, Homo sapiens
gcgcgcgcctaaggttactaggcgatgttatttctgtttctcttggtgttcatcaacca

SEQ ID NO: 149 - DNA, 46 bp, Homo sapiens; identical to SEQ ID NO: 147

SEQ ID NO: 150 - DNA, 59 bp, Homo sapiens; identical to SEQ ID NO: 148

SEQ ID NO: 151 - DNA, 111 bp, Homo sapiens
cattcacagggcacattcaccagtgactacagcaagtatctggactccaggcgtgcccaagattttgtgcagtggttgatgaataccaagaggaacaggaataacattgcc

SEQ ID NO: 152 - DNA, 111 bp, Homo sapiens; identical to SEQ ID NO: 151

SEQ ID NO: 153 - protein, 646 aa, Homo sapiens
MKWVSFISLLFLFSSAYSRSLDKRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHSQGTFTSDYSKYLDSRRAQDFVQWLMNTKRNRNNIA

SEQ ID NO: 154 - protein, 646 aa, Homo sapiens
MKWVSFISLLFLFSSAYSRSLDKRHSQGTFTSDYSKYLDSRRAQDFVQWLMNTKRNRNNIADAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 155 - protein, 37 aa, Homo sapiens; identical to SEQ ID NO: 133

SEQ ID NO: 156 - protein, 37 aa, Homo sapiens; identical to SEQ ID NO: 133

SEQ ID NO: 157 - DNA, 1494 bp, Homo sapiens
gcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcatcgccagtga

SEQ ID NO: 158 - DNA, 1494 bp, Homo sapiens; identical to SEQ ID NO: 157

SEQ ID NO: 159 - DNA, 1494 bp, Homo sapiens; identical to SEQ ID NO: 157

SEQ ID NO: 160 - DNA, 1494 bp, Homo sapiens; identical to SEQ ID NO: 157

SEQ ID NO: 161 - protein, 1106 aa, Homo sapiens
MKWVSFISLLFLFSSAYSRSLDKRARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 162 - protein, 1103 aa, Homo sapiens
MWWRLWWLLLLLLLLWPMVWAARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 163 - protein, 1106 aa, Homo sapiens
MKWVSFISLLFLFSSAYSRSLDKRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 164 - protein, 1106 aa, Homo sapiens; identical to SEQ ID NO: 163

SEQ ID NO: 165 - protein, 497 aa, Homo sapiens
ARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 166 - protein, 497 aa, Homo sapiens; identical to SEQ ID NO: 165

SEQ ID NO: 167 - protein, 497 aa, Homo sapiens; identical to SEQ ID NO: 165

SEQ ID NO: 168 - protein, 497 aa, Homo sapiens; identical to SEQ ID NO: 165

SEQ ID NO: 169 - DNA, 111 bp, Homo sapiens
cactcccaaggtaccttcacctccgactactccaagtacttggactccagaagagcccaagacttcgtgcaatggttgatgaacaccaagagaaacagaaataacatcgcc

SEQ ID NO: 170 - DNA, 111 bp, Homo sapiens; identical to SEQ ID NO: 169

SEQ ID NO: 171 - DNA, 111 bp, Homo sapiens; identical to SEQ ID NO: 169

SEQ ID NO: 172 - DNA, 84 bp, Homo sapiens
tctgctaactcaaacccggctatggcaccccgagaacgcaaagctggctgcaagaatttcttctggaagactttcacatcctgt

SEQ ID NO: 173 - DNA, 84 bp, Homo sapiens; identical to SEQ ID NO: 172

SEQ ID NO: 174 - DNA, 1809 bp, Homo sapiens; identical to SEQ ID NO: 117

SEQ ID NO: 175 - DNA, 120 bp, Homo sapiens
gacaacccttctctgtccattgacctcacctttcacctgctgcggaccctgctggagctggcgcggacgcagagccagcgggagcgcgccgagcagaaccgcatcatattcgactcggtg

SEQ ID NO: 176 - DNA, 120 bp, Homo sapiens; identical to SEQ ID NO: 175

SEQ ID NO: 177 - DNA, 120 bp, Homo sapiens; identical to SEQ ID NO: 175

SEQ ID NO: 178 - DNA, 120 bp, Homo sapiens; identical to SEQ ID NO: 175

SEQ ID NO: 179 - DNA, 114 bp, Homo sapiens
attgtcctatcgctggatgtccccatcggcctcttgcagatcttactggagcaagcccgggccagggctgccagggagcaggccaccaccaacgcccgcatcctggcccgtgtc

SEQ ID NO: 180 - DNA, 114 bp, Homo sapiens; identical to SEQ ID NO: 179

SEQ ID NO: 181 - DNA, 114 bp, Homo sapiens; identical to SEQ ID NO: 179

SEQ ID NO: 182 - DNA, 114 bp, Homo sapiens; identical to SEQ ID NO: 179

SEQ ID NO: 183 - DNA, 1809 bp, Homo sapiens; identical to SEQ ID NO: 117

SEQ ID NO: 184 - DNA, 1809 bp, Homo sapiens; identical to SEQ ID NO: 117

SEQ ID NO: 185 - DNA, 120 bp, Homo sapiens; identical to SEQ ID NO: 175

SEQ ID NO: 186 - DNA, 120 bp, Homo sapiens; identical to SEQ ID NO: 175

SEQ ID NO: 187 - DNA, 114 bp, Homo sapiens; identical to SEQ ID NO: 179

SEQ ID NO: 188 - DNA, 114 bp, Homo sapiens; identical to SEQ ID NO: 179

SEQ ID NO: 189 - DNA, 120 bp, Homo sapiens; identical to SEQ ID NO: 175

SEQ ID NO: 190 - DNA, 120 bp, Homo sapiens; identical to SEQ ID NO: 175

SEQ ID NO: 191 - DNA, 114 bp, Homo sapiens; identical to SEQ ID NO: 179

SEQ ID NO: 192 - DNA, 114 bp, Homo sapiens; identical to SEQ ID NO: 179

SEQ ID NO: 193 - DNA, 1494 bp, Homo sapiens
gcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattccggagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtga

SEQ ID NO: 194 - DNA, 1494 bp, Homo sapiens
gcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtga

SEQ ID NO: 195 - DNA, 459 bp, Homo sapiens
atgggaaaaatcagcagtcttccaacccaattatttaagtgctgcttttgtgatttcttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaaggaagtacatttgaagaacgcaagtagagggagtgcaggaaacaagaactacaggatg

SEQ ID NO: 196 - DNA, 459 bp, Homo sapiens; identical to SEQ ID NO: 195

SEQ ID NO: 197 - DNA, 1809 bp, Homo sapiens; identical to SEQ ID NO: 117

SEQ ID NO: 198 - DNA, 111 bp, Homo sapiens; identical to SEQ ID NO: 110

SEQ ID NO: 199 - DNA, 111 bp, Homo sapiens; identical to SEQ ID NO: 110

SEQ ID NO: 200 - DNA, 111 bp, Homo sapiens; identical to SEQ ID NO: 110

SEQ ID NO: 201 - DNA, 111 bp, Homo sapiens; identical to SEQ ID NO: 110

SEQ ID NO: 202 - DNA, 111 bp, Homo sapiens; identical to SEQ ID NO: 110

SEQ ID NO: 203 - DNA, 111 bp, Homo sapiens; identical to SEQ ID NO: 110

SEQ ID NO: 204 - DNA, 1809 bp, Homo sapiens; identical to SEQ ID NO: 117

SEQ ID NO: 205 - DNA, 1809 bp, Homo sapiens; identical to SEQ ID NO: 117

SEQ ID NO: 206 - DNA, 1809 bp, Homo sapiens; identical to SEQ ID NO: 117

SEQ ID NO: 207 - DNA, 111 bp, Homo sapiens; identical to SEQ ID NO: 169

SEQ ID NO: 208 - DNA, 111 bp, Homo sapiens; identical to SEQ ID NO: 169

SEQ ID NO: 209 - DNA, 111 bp, Homo sapiens; identical to SEQ ID NO: 169

SEQ ID NO: 210 - DNA, 1494 bp, Homo sapiens; identical to SEQ ID NO: 193

SEQ ID NO: 211 - DNA, 1494 bp, Homo sapiens; identical to SEQ ID NO: 193

SEQ ID NO: 212 - DNA, 1494 bp, Homo sapiens; identical to SEQ ID NO: 193

SEQ ID NO: 213 - DNA, 1494 bp, Homo sapiens; identical to SEQ ID NO: 193

SEQ ID NO: 214 - DNA, 111 bp, Homo sapiens; identical to SEQ ID NO: 169

SEQ ID NO: 215 - DNA, 111 bp, Homo sapiens; identical to SEQ ID NO: 169

SEQ ID NO: 216 - DNA, 1599 bp, Homo sapiens
ttaggcttagaagatgacataataatcgctactaagaacggtaaggttagaggtatgcaattgactgtattcggtggaactgtaactgctttcttgggtattccatacgctcaacctccattaggtagattgaggtttaagaaaccacaatctttgactaaatggtctgatatttggcaagctactaagtatgctaactcttgctgtcagaacatagaccaatctttcccaggtttccatggttcagaaatgtggaacccaaacacagatttatctgaagactgtttatacttaaatgtatggatccctgctcctaaaccaaagcaagctactgtcttgatatggatatacggtggaggtttccaaacaggaacttcttcattgcatgtttatgatggtaagttcttggctagagttgaaagggttattgtagtttcaatgaattatagagttggtgcattgggtttcttagctttgcctggaaatcctgaagctccaggtaatatgggtttattcgaccagcaattagccttgcagtgggtacagaagaacattgctgcctttggaggtaatccaaagtctgttacattattcggagagtctgccggtgctgcatctgtttcattacatttattgtctccaggttctcactctttatttactagagccatattgcaatctggttcattcaatgcaccatgggctgttacatctttgtatgaagctagacaaaggacattgaacttagctaaattaacaggttgttcaagagaacaagaaacagagattataaagtgtttaagaaataaggatccacaagaaatattattgaatgaagcattcgttgtaccatacggtactccattgtctgttaatttcggtccaactgttgatggtgatttcttaacagatatgcctgatatattgttggaattaggtcaattcaagaagacacaaatcttggtaggtgttaataaggacgaaggtactgcattcttggtttatggtgcacctggtttctctaaggatcagaactctattataactagaaaggaatttcaagagggtttgaagatattctttcctggtgtttcagaattcggtaaggaatctatcttgtttcattatacagattgggttgacgatcagaggccagagaactatagagaagctttaggtgatgtcgttggtgactataatttcatatgtccagccttagaatttacaaagaaattctcagaatggggtaataacgcattcttctattactttgaacacaggtcatctaagttaccatggccagagtggatgggtgttatgcacggttacgaaattgaatttgtcttcggtttgccattggaaagaagggatcaatacactaaagctgaagagatcttatctagatcaattgttaagagatgggctaatttcgctaaatatggtaatcctcaagagactcagaatcaatctacttcatggcctgtattcaaatctactgaacagaagtatttaacattaaacactgaatcaacaagaattatgactaaattgagagcacaacagtgcagattctggacatcattctttccaaaggtttaa

SEQ ID NO: 217 - DNA, 1809 bp, Homo sapiens; identical to SEQ ID NO: 117

SEQ ID NO: 218 - DNA, 1809 bp, Homo sapiens; identical to SEQ ID NO: 117

SEQ ID NO: 219 - DNA, 1809 bp, Homo sapiens; identical to SEQ ID NO: 117

SEQ ID NO: 220 - DNA, 1494 bp, Homo sapiens; identical to SEQ ID NO: 193

SEQ ID NO: 221 - DNA, 111 bp, Homo sapiens; identical to SEQ ID NO: 169

SEQ ID NO: 222 - DNA, 111 bp, Homo sapiens; identical to SEQ ID NO: 169

SEQ ID NO: 223 - DNA, 1809 bp, Homo sapiens; identical to SEQ ID NO: 117

SEQ ID NO: 224 - DNA, 1809 bp, Homo sapiens; identical to SEQ ID NO: 117

SEQ ID NO: 225 - DNA, 1809 bp, Homo sapiens; identical to SEQ ID NO: 117

SEQ ID NO: 226 - DNA, 1809 bp, Homo sapiens; identical to SEQ ID NO: 117

SEQ ID NO: 227 - DNA, 1587 bp, Homo sapiens
gaagatgacataataatcgctactaagaacggtaaggttagaggtatgcaattgactgtattcggtggaactgtaactgctttcttgggtattccatacgctcaacctccattaggtagattgaggtttaagaaaccacaatctttgactaaatggtctgatatttggcaagctactaagtatgctaactcttgctgtcagaacatagaccaatctttcccaggtttccatggttcagaaatgtggaacccaaacacagatttatctgaagactgtttatacttaaatgtatggatccctgctcctaaaccaaagcaagctactgtcttgatatggatatacggtggaggtttccaaacaggaacttcttcattgcatgtttatgatggtaagttcttggctagagttgaaagggttattgtagtttcaatgaattatagagttggtgcattgggtttcttagctttgcctggaaatcctgaagctccaggtaatatgggtttattcgaccagcaattagccttgcagtgggtacagaagaacattgctgcctttggaggtaatccaaagtctgttacattattcggagagtctgccggtgctgcatctgtttcattacatttattgtctccaggttctcactctttatttactagagccatattgcaatctggttcattcaatgcaccatgggctgttacatctttgtatgaagctagacaaaggacattgaacttagctaaattaacaggttgttcaagagaacaagaaacagagattataaagtgtttaagaaataaggatccacaagaaatattattgaatgaagcattcgttgtaccatacggtactccattgtctgttaatttcggtccaactgttgatggtgatttcttaacagatatgcctgatatattgttggaattaggtcaattcaagaagacacaaatcttggtaggtgttaataaggacgaaggtactgcattcttggtttatggtgcacctggtttctctaaggatcagaactctattataactagaaaggaatttcaagagggtttgaagatattctttcctggtgtttcagaattcggtaaggaatctatcttgtttcattatacagattgggttgacgatcagaggccagagaactatagagaagctttaggtgatgtcgttggtgactataatttcatatgtccagccttagaatttacaaagaaattctcagaatggggtaataacgcattcttctattactttgaacacaggtcatctaagttaccatggccagagtggatgggtgttatgcacggttacgaaattgaatttgtcttcggtttgccattggaaagaagggatcaatacactaaagctgaagagatcttatctagatcaattgttaagagatgggctaatttcgctaaatatggtaatcctcaagagactcagaatcaatctacttcatggcctgtattcaaatctactgaacagaagtatttaacattaaacactgaatcaacaagaattatgactaaattgagagcacaacagtgcagattctggacatcattctttccaaaggtt

SEQ ID NO: 228 - DNA, 1494 bp, Homo sapiens; identical to SEQ ID NO: 193

SEQ ID NO: 229 - DNA, 87 bp, Homo sapiens
cactcccaaggtaccttcacctccgactactccaagtacttggactccagaagagcccaagacttcgtgcaatggttgatgaacacc

SEQ ID NO: 230 - DNA, 87 bp, Homo sapiens; identical to SEQ ID NO: 229

SEQ ID NO: 231 - DNA, 87 bp, Homo sapiens; identical to SEQ ID NO: 229

SEQ ID NO: 232 - DNA, 1359 bp, Homo sapiens
atgtccactgcggtcctggaaaacccaggcttgggcaggaaactctctgactttggacaggaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctcagctatggagcggaactggatgctgaccaccctggttttaaagatcctgtgtaccgtgcaagacggaagcagtttgctgacattgcctacaactaccgccatgggcagcccatccctcgagtggaatacatggaggaagraaagaaaacatggggcacagtgttcaagactctgaagtccttgtataaaacccatgcttgctatgagtacaatcacatttttccacttcttgaaaagtactgtggcttccatgaagataacattccccagctggaagacgtttctcaattcctgcagacttgcactggtttccgcctccgacctgtggctggcctgctttcctctcgggatttcttgggtggcctggccttccgagtcttccactgcacacagtacatcagacatggatccaagcccatgtatacccccgaacctgacatctgccatgagctgttgggacatgtgcccttgttttcagatcgcagctttgcccagttttcccaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccaaaattacactgtcacggagttccagcccctgtattacgtggcagagagttttaatgatgccaaggagaaagtaaggaactttgctgccacaatacctcggcccttctcagttcgctacgacccatacacccaaaggattgaggtcttggacaatacccagcagcttaagattttggctgattccattaacagtgaaattggaatcctttgcagtgccctccagaaaataaagtaa

SEQ ID NO: 233 - DNA, 87 bp, Homo sapiens; identical to SEQ ID NO: 229

SEQ ID NO: 234 - DNA, 87 bp, Homo sapiens; identical to SEQ ID NO: 229

SEQ ID NO: 235 - DNA, 1809 bp, Homo sapiens; identical to SEQ ID NO: 117

SEQ ID NO: 236 - DNA, 1359 bp, Homo sapiens; identical to SEQ ID NO: 232

SEQ ID NO: 237 - DNA, 1359 bp, Homo sapiens; identical to SEQ ID NO: 232

SEQ ID NO: 238 - DNA, 1359 bp, Homo sapiens; identical to SEQ ID NO: 232

SEQ ID NO: 239 - DNA, 1359 bp, Homo sapiens; identical to SEQ ID NO: 232

SEQ ID NO: 240 - DNA, 1359 bp, Homo sapiens; identical to SEQ ID NO: 232

SEQ ID NO: 241 - DNA, 111 bp, Homo sapiens; identical to SEQ ID NO: 169

SEQ ID NO: 242 - DNA, 1359 bp, Homo sapiens; identical to SEQ ID NO: 232

SEQ ID NO: 243 - DNA, 1359 bp, Homo sapiens; identical to SEQ ID NO: 232

SEQ ID NO: 244 - DNA, 1359 bp, Homo sapiens; identical to SEQ ID NO: 232

SEQ ID NO: 245 - DNA, 1359 bp, Homo sapiens; identical to SEQ ID NO: 232

SEQ ID NO: 246 - DNA, 1359 bp, Homo sapiens; identical to SEQ ID NO: 232

SEQ ID NO: 247 - DNA, 1359 bp, Homo sapiens; identical to SEQ ID NO: 232

SEQ ID NO: 248 - DNA, 1359 bp, Homo sapiens; identical to SEQ ID NO: 232

SEQ ID NO: 249 - DNA, 1359 bp, Homo sapiens; identical to SEQ ID NO: 232

SEQ ID NO: 250 - DNA, 111 bp, Homo sapiens; identical to SEQ ID NO: 169

SEQ ID NO: 251 - protein, 678 aa, Homo sapiens
MLLQAFLFLLAGFAAKISAHSQGTFTSDYSKYLDSRRAQDFVQWLMNTKRNRNNIAHSQGTFTSDYSKYLDSRRAQDFVQWLMNTKRNRNNIADAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 252 - protein, 683 aa, Homo sapiens
MKWVSFISLLFLFSSAYSGSLDKRHSQGTFTSDYSKYLDSRRAQDFVQWLMNTKRNRNNIAHSQGTFTSDYSKYLDSRRAQDFVQWLMNTKRNRNNIADAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 253 - protein, 646 aa, Homo sapiens
MKWVSFISLLFLFSSAYSGSLDKRHSQGTFTSDYSKYLDSRRAQDFVQWLMNTKRNRNNIADAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 254 - protein, 636 aa, Homo sapiens
MKWVSFISLLFLFSSAYSRSLDKRSANSNPAMAPRERKAGCKNFFWKTFTSCAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 255 - protein, 637 aa, Homo sapiens
MKWVSFISLLFLFSSAYSRSLDKRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLSANSNPAMAPRERKAGCKNFFWKTFTSC

SEQ ID NO: 256 - protein, 1138 aa, Homo sapiens
MKWVSFISLLFLFSSAYSRSLDKREDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESAGAASVSLHLLSPGSHSLFTRAILQSGSFNAPWAVTSLYEARNRTLNLAKLTGCSRENETEIIKCLRNKDPQEILLNEAFVVPYGTPLSVNFGPTVDGDFLTDMPDILLELGQFKKTQILVGVNKDEGTWFLVAGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 257 - protein, 649 aa, Homo sapiens
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLDNPSLSIDLTFHLLRTLLELARTQSQRERAEQNRIIFDSV

SEQ ID NO: 258 - protein, 689 aa, Homo sapiens
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLDNPSLSIDLTFHLLRTLLELARTQSQRERAEQNRIIFDSVDNPSLSIDLTFHLLRTLLELARTQSQRERAEQNRIIFDSV

SEQ ID NO: 259 - protein, 649 aa, Homo sapiens
MKWVTFISLLFLFSSAYSRGVFRRDNPSLSIDLTFHLLRTLLELARTQSQRERAEQNRIIFDSVDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 260 - protein, 689 aa, Homo sapiens
MKWVTFISLLFLFSSAYSRGVFRRDNPSLSIDLTFHLLRTLLELARTQSQRERAEQNRIIFDSVDNPSLSIDLTFHLLRTLLELARTQSQRERAEQNRIIFDSVDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 261 - protein, 647 aa, Homo sapiens
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLIVLSLDVPIGLLQILLEQARARAAREQATTNARILARV

SEQ ID NO: 262 - protein, 685 aa, Homo sapiens
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLIVLSLDVPIGLLQILLEQARARAAREQATTNARILARVIVLSLEVPIGLLQILLEQARARAAREQATTNARILARV

SEQ ID NO: 263 - protein, 647 aa, Homo sapiens
MKWVTFISLLFLFSSAYSRGVFRRIVLSLDVPIGLLQILLEQARARAAREQATTNARILARVDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 264 - protein, 685 aa, Homo sapiens
MKWVTFISLLFLFSSAYSRGVFRRIVLSLDVPIGLLQILLEQARARAAREQATTNARILARVIVLSLEVPIGLLQILLEQARARAAREQATTNARILARVDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 265 - protein, 1138 aa, Homo sapiens
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLEDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESAGAASVSLHLLSPGSHSLFTRAILQSGSFNAPWAVTSLYEARNRTLNLAKLTGCSRENETEIIKCLRNKDPQEILLNEAFVVPYGTPLSVNFGPTVDGDFLTDMPDILLELGQFKKTQILVGVNKDEGTWFLVAGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKV

SEQ ID NO: 266 - protein, 1138 aa, Homo sapiens
MKWVSFISLLFLFSSAYSRSLDKRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLEDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESAGAASVSLHLLSPGSHSLFTRAILQSGSFNAPWAVTSLYEARNRTLNLAKLTGCSRENETEIIKCLRNKDPQEILLNEAFVVPYGTPLSVNFGPTVDGDFLTDMPDILLELGQFKKTQILVGVNKDEGTWFLVAGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKV

SEQ ID NO: 267 - protein, 649 aa, Homo sapiens
MKWVSFISLLFLFSSAYSRSLDKRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLDNPSLSIDLTFHLLRTLLELARTQSQRERAEQNRIIFDSV

SEQ ID NO: 268 - protein, 689 aa, Homo sapiens
MKWVSFISLLFLFSSAYSRSLDKRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLDNPSLSIDLTFHLLRTLLELARTQSQRERAEQNRIIFDSVDNPSLSIDLTFHLLRTLLELARTQSQRERAEQNRIIFDSV

SEQ ID NO: 269 - protein, 647 aa, Homo sapiens
MKWVSFISLLFLFSSAYSRSLDKRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLIVLSLDVPIGLLQILLEQARARAAREQATTNARILARV

SEQ ID NO: 270 - protein, 685 aa, Homo sapiens
MKWVSFISLLFLFSSAYSRSLDKRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLIVLSLDVPIGLLQILLEQARARAAREQATTNARILARVIVLSLDVPIGLLQILLEQARARAAREQATTNARILARV

SEQ ID NO: 271 - protein, 649 aa, Homo sapiens
MKWVSFISLLFLFSSAYSRSLDKRDNPSLSIDLTFHLLRTLLELARTQSQRERAEQNRIIFDSVDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 272 - protein, 689 aa, Homo sapiens
MKWVSFISLLFLFSSAYSRSLDKRDNPSLSIDLTFHLLRTLLELARTQSQRERAEQNRIIFDSVDNPSLSIDLTFHLLRTLLELARTQSQRERAEQNRIIFDSVDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 273 - protein, 647 aa, Homo sapiens
MKWVSFISLLFLFSSAYSRSLDKRIVLSLDVPIGLLQILLEQARARAAREQATTNARILARVDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 274 - protein, 685 aa, Homo sapiens
MKWVSFISLLFLFSSAYSRSLDKRIVLSLDVPIGLLQILLEQARARAAREQATTNARILARVIVLSLDVPIGLLQILLEQARARAAREQATTNARILARVDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 275 - protein, 1603 aa, Homo sapiens
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 276 - protein, 1105 aa, Homo sapiens
MRPTWAWWLFLVLLLALWAPARGARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 277 - protein, 679 aa, Homo sapiens
MKWVTFISLLFLFSSAYSRGVFRRGPETLCGAELVDALQFVCGDRGFYFNKPTGYGSSSRRAPQTGIVDECCFRSCDLRRLEMYCAPLKPAKSADAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 278 - protein, 679 aa, Homo sapiens
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGPETLCGAELVDALQFVCGDRGFYFNKPTGYGSSSRRAPQTGIVDECCFRSCDLRRLEMYCAPLKPAKSA

SEQ ID NO: 279 - protein, 1137 aa, Homo sapiens
MRPTWAWWLFLVLLLALWAPARGEDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESAGAASVSLHLLSPGSHSLFTRAILQSGSFNAPWAVTSLYEARNRTLNLAKLTGCSRENETEIIKCLRNKDPQEILLNEAFVVPYGTPLSVNFGPTVDGDFLTDMPDILLELGQFKKTQILVGVNKDEGTAFLVYGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 280 - protein, 638 aa, Homo sapiens
MRPTWAWWLFLVLLLALWAPARGVTHRLAGLLSRSGGVVKNNFVPTNVGSKAFDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 281 - protein, 634 aa, Homo sapiens
MRPTWAWWLFLVLLLALWAPARGLAGLLSRSGGVVKNNFVPTNVGSKAFDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 282 - protein, 639 aa, Homo sapiens; identical to SEQ ID NO: 125

SEQ ID NO: 283 - protein, 635 aa, Homo sapiens; identical to SEQ ID NO: 127

SEQ ID NO: 284 - protein, 640 aa, Homo sapiens
MKWVSFISLLFLFSSAYSRSLDKRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLVTHRLAGLLSRSGGVVKNNFVPTNVGSKAFG

SEQ ID NO: 285 - protein, 636 aa, Homo sapiens
MKWVSFISLLFLFSSAYSRSLDKRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLLAGLLSRSGGVVKNNFVPTNVGSKAFG

SEQ ID NO: 286 - protein, 1137 aa, Homo sapiens
MRPTWAWWLFLVLLLALWAPARGEDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESAGAASVSLHLLSPGSHSLFTRAILQSGSFNAPWAVTSLYEARNRTLNLAKLTGCSRENETEIIKCLRNKDPQEILLNEAFVVPYGTPLSVNFGPTVDGDFLTDMPDILLELGQFKKTQILVGVNKDEGTWFLVAGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 287 - protein, 1138 aa, Homo sapiens; identical to SEQ ID NO: 265

SEQ ID NO: 288 - protein, 1137 aa, Homo sapiens; identical to SEQ ID NO: 279

SEQ ID NO: 289 - protein, 639 aa, Homo sapiens
MKWVSFISLLFLFSSAYSGSLDKRHSQGTFTSDYSKYLDSRRAQDFVQWLMNTKDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 290 - protein, 639 aa, Homo sapiens
MKWVSFISLLFLFSSAYSGSLDKRHSQGTFTSDYSKYLDSRAAQDFVQWLMNTKDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 291 - protein, 646 aa, Homo sapiens
MKWVSFISLLFLFSSAYSGSLDKRHSQGTFTSDYSKYLDSRAAQDFVQWLMNTKRNRNNIADAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 292 - protein, 1106 aa, Homo sapiens
MKWVSFISLLFLFSSAYSGSLDKRARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 293 - protein, 1106 aa, Homo sapiens; identical to SEQ ID NO: 163

SEQ ID NO: 294 - protein, 1105 aa, Homo sapiens; identical to SEQ ID NO: 276

SEQ ID NO: 295 - protein, 1106 aa, Homo sapiens
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 296 - protein, 646 aa, Homo sapiens
MKWVSFISLLFLFSSAYSGSLDKRHSQGTFTSDYSKYLDSRRAQDFVQWLMNTGRNRNNIADAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 297 - protein, 669 aa, Homo sapiens
MKWVSFISLLFLFSSAYSGSLDKRHSQGTFTSDYSKYLDSRRAQDFVQWLMNTKHSQGTFTSDYSKYLDSRRAQDFVQWLMNTKDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 298 - protein, 1140 aa, Homo sapiens [sequence omitted]

SEQ ID NO: 299 - protein, 1137 aa, Homo sapiens
MRPTWAWWLFLVLLLALWAPARGEDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGHFQTGTSSLHVYDGKFLARVERVIVVSMNYRVGALGFLALPGNPEAPGNMGLFDQQLALQWVQKNIAAFGGNPKSVTLFGESAGAASVSLHLLSPGSHSLFTRAILQSGSFNAPWAVTSLYEARNRTLNLAKLTGCSRENETEIIKCLRNKDPQEILLNEAFVVPYGTPLSVNFGPTVDGDFLTDMPDILLELGQFKKTQILVGVNKDEGTAFLVYGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 300 - protein, 1137 aa, Homo sapiens
MRPTWAWWLFLVLLLALWAPARGEDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSFNAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 301 - protein, 1137 aa, Homo sapiens
MRPTWAWWLFLVLLLALWAPARGEDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGHFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSFNAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 302 - protein, 1106 aa, Homo sapiens; identical to SEQ ID NO: 163

SEQ ID NO: 303 - protein, 669 aa, Homo sapiens
MKWVSFISLLFLFSSAYSGSLDKRHSQGTFTSDYSKYLDSRAAQDFVQWLMNTKHSQGTFTSDYSKYLDSRAAQDFVQWLMNTKDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 304 - protein, 646 aa, Homo sapiens
MKWVSFISLLFLFSSAYSGSLDKRHSQGTFTSDYSKYLDSRAAQDFVQWLMNTGRNRNNIADAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 305 - protein, 1137 aa, Homo sapiens; identical to SEQ ID NO: 299

SEQ ID NO: 306 - protein, 1137 aa, Homo sapiens; identical to SEQ ID NO: 300

SEQ ID NO: 307 - protein, 1137 aa, Homo sapiens; identical to SEQ ID NO: 301

SEQ ID NO: 308 - protein, 1138 aa, Homo sapiens
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLEDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGHFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSFNAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKV

SEQ ID NO: 309 - protein, 1138 aa, Homo sapiens
MKWVSFISLLFLFSSAYSGSLDKRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLEDDIIIATKNGKVRGMQLTVFGGTVTAFLGIPYAQPPLGRLRFKKPQSLTKWSDIWQATKYANSCCQNIDQSFPGFHGSEMWNPNTDLSEDCLYLNVWIPAPKPKQATVLIWIYGGGFQTGTSSLHVYDGKFLARVERVIVVSMNYRVGALGFLALPGNPEAPGNMGLFDQQLALQWVQKNIAAFGGNPKSVTLFGESAGAASVSLHLLSPGSHSLFTRAILQSGSFNAPWAVTSLYEARQRTLNLAKLTGCSREQETEIIKCLRNKDPQEILLNEAFVVPYGTPLSVNFGPTVDGDFLTDMPDILLELGQFKKTQILVGVNKDEGTAFLVYGAPGFSKDQNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDQYTKAEEILSRSIVKRWANFAKYGNPQETQNQSTSWPVFKSTEQKYLTLNTESTRIMTKLRAQQCRFWTSFFPKV

SEQ ID NO: 310 - protein, 964 aa, Homo sapiens
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGG

SEQ ID NO: 311 - protein, 638 aa, Homo sapiens
MKWVSFISLLFLFSSAYSGSLDKRHSQGTFTSDYSKYLDARRAQDFVQWLMNTDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 312 - protein, 638 aa, Homo sapiens
MKWVSFISLLFLFSSAYSGSLDKRHSQGTFTSDYSKYLDARAAQDFVQWLMNTDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 313 - protein, 638 aa, Homo sapiens
MKWVSFISLLFLFSSAYSRSLDKRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHSQGTFTSDYSKYLDARAAQDFVQWLMNT

SEQ ID NO: 314 - protein, 878 aa, Homo sapiens
  MISC_FEATURE (65): Xaa equals Glu or Gly
MKWVSFISLLFLFSSAYSRSLDKRDADHPGFKDPVYRARRKQFADIAYNYRHGQPIPRVEYMEEXKKTWGTVFKTLKSLYKTHACYEYNHIFPLLEKYCGFHEDNIPQLEDVSQFLQTCTGFRLRPVAGLLSSRDFLGGLAFRVFHCTQYIRHGSKPMYTPEPDICHELLGHVPLFSDRSFAQFSQEIGLASLGAPDEYIEKLATIYWFTVEFGLCKQGDSIKAYGAGLLSSFGELQYCLSEKPKLLPLELEKTAIQNYTVTEFQPLYYVAESFNDAKEKVRNFAATIPRPFSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 315 - protein, 637 aa, Homo sapiens
MKWVSFISLLFLFSSAYSGSLDKRSQGTFTSGYSKYLDSRAAQDFVQWLMNTDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 316 - protein, 637 aa, Homo sapiens
MKWVSFISLLFLFSSAYSRSLDKRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLSQGTFTSGYSKYLDSRAAQDFVQWLMNT

SEQ ID NO: 317 - protein, 1138 aa, Homo sapiens
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLEDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSFNAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKV

SEQ ID NO: 318 - protein, 936 aa, Homo sapiens
  MISC_FEATURE (691): Xaa equals Glu or Gly
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLIGATVHELSRDKKKDTVPWFPRTIQELDRFANQILSYGAELDADHPGFKDPVYRARRKQFADIAYNYRHGQPIPRVEYMEEXKKTWGTVFKTLKSLYKTHACYEYNHIFPLLEKYCGFHEDNIPQLEDVSQFLQTCTGFRLRPVAGLLSSRDFLGGLAFRVFHCTQYIRHGSKPMYTPEPDICHELLGHVPLFSDRSFAQFSQEIGLASLGAPDEYIEKLATIYWFTVEFGLCKQGDSIKAYGAGLLSSFGELQYCLSEKPKLLPLELEKTAIQNYTVTEFQPLYYVAESFNDAKEKVRNFAATIPRPFSVRYDPYTQRIEVLDNTQ

SEQ ID NO: 319 - protein, 936 aa, Homo sapiens
  MISC_FEATURE (106): Xaa equals Glu or Gly
MKWVTFISLLFLFSSAYSRGVFRRIGATVHELSRDKKKDTVPWFPRTIQELDRFANQILSYGAELDADHPGFKDPVYRARRKQFADIAYNYRHGQPIPRVEYMEEXKKTWGTVFKTLKSLYKTHACYEYNHIFPLLEKYCGFHEDNIPQLEDVSQFLQTCTGFRLRPVAGLLSSRDFLGGLAFRVFHCTQYIRHGSKPMYTPEPDICHELLGHVPLFSDRSFAQFSQEIGLASLGAPDEYIEKLATIYWFTVEFGLCKQGDSIKAYGAGLLSSFGELQYCLSEKPKLLPLELEKTAIQNYTVTEFQPLYYVAESFNDAKEKVRNFAATIPRPFSVRYDPYTQRIEVLDNTQDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 320 - protein, 936 aa, Homo sapiens
  MISC_FEATURE (691): Xaa equals Glu or Gly
MKWVSFISLLFLFSSAYSRSLDKRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLIGATVHELSRDKKKDTVPWFPRTIQELDRFANQILSYGAELDADHPGFKDPVYRARRKQFADIAYNYRHGQPIPRVEYMEEXKKTWGTVFKTLKSLYKTHACYEYNHIFPLLEKYCGFHEDNIPQLEDVSQFLQTCTGFRLRPVAGLLSSRDFLGGLAFRVFHCTQYIRHGSKPMYTPEPDICHELLGHVPLFSDRSFAQFSQEIGLASLGAPDEYIEKLATIYWFTVEFGLCKQGDSIKAYGAGLLSSFGELQYCLSEKPKLLPLELEKTAIQNYTVTEFQPLYYVAESFNDAKEKVRNFAATIPRPFSVRYDPYTQRIEVLDNTQ

SEQ ID NO: 321 - protein, 936 aa, Homo sapiens
  MISC_FEATURE (106): Xaa equals Glu or Gly
MKWVSFISLLFLFSSAYSRSLDKRIGATVHELSRDKKKDTVPWFPRTIQELDRFANQILSYGAELDADHPGFKDPVYRARRKQFADIAYNYRHGQPIPRVEYMEEXKKTWGTVFKTLKSLYKTHACYEYNHIFPLLEKYCGFHEDNIPQLEDVSQFLQTCTGFRLRPVAGLLSSRDFLGGLAFRVFHCTQYIRHGSKPMYTPEPDICHELLGHVPLFSDRSFAQFSQEIGLASLGAPDEYIEKLATIYWFTVEFGLCKQGDSIKAYGAGLLSSFGELQYCLSEKPKLLPLELEKTAIQNYTVTEFQPLYYVAESFNDAKEKVRNFAATIPRPFSVRYDPYTQRIEVLDNTQDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 322 - protein, 922 aa, Homo sapiens
  MISC_FEATURE (677): Xaa equals Glu or Gly
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLDTVPWFPRTIQELDRFANQILSYGAELDADHPGFKDPVYRARRKQFADIAYNYRHGQPIPRVEYMEEXKKTWGTVFKTLKSLYKTHACYEYNHIFPLLEKYCGFHEDNIPQLEDVSQFLQTCTGFRLRPVAGLLSSRDFLGGLAFRVFHCTQYIRHGSKPMYTPEPDICHELLGHVPLFSDRSFAQFSQEIGLASLGAPDEYIEKLATIYWFTVEFGLCKQGDSIKAYGAGLLSSFGELQYCLSEKPKLLPLELEKTAIQNYTVTEFQPLYYVAESFNDAKEKVRNFAATIPRPFSVRYDPYTQRIEVLDNTQ

SEQ ID NO: 323 - protein, 653 aa, Homo sapiens
MKWVSFISLLFLFSSAYSGSLDKRHSQGTFTSDYSKYLDSQRAQDFVQWLMNTQRNRNNIAGGGGGSYDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 324 - protein, 1037 aa, Homo sapiens
  MISC_FEATURE (792): Xaa equals Glu or Gly
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLMSTAVLENPGLGRKLSDFGQETSYIEDNCNQNGAISLIFSLKEEVGALAKVLRLFEENDVNLTHIESRPSRLKKDEYEFFTHLDKRSLPALTNIIKILRHDIGATVHELSRDKKKDTVPWFPRTIQELDRFANQILSYGAELDADHPGFKDPVYRARRKQFADIAYNYRHGQPIPRVEYMEEXKKTWGTVFKTLKSLYKTHACYEYNHIFPLLEKYCGFHEDNIPQLEDVSQFLQTCTGFRLRPVAGLLSSRDFLGGLAFRVFHCTQYIRHGSKPMYTPEPDICHELLGHVPLFSDRSFAQFSQEIGLASLGAPDEYIEKLATIYWFTVEFGLCKQGDSIKAYGAGLLSSFGELQYCLSEKPKLLPLELEKTAIQNYTVTEFQPLYYVAESFNDAKEKVRNFAATIPRPFSVRYDPYTQRIEVLDNTQ

SEQ ID NO: 325 - protein, 1037 aa, Homo sapiens
  MISC_FEATURE (207): Xaa equals Glu or Gly
MKWVTFISLLFLFSSAYSRGVFRRMSTAVLENPGLGRKLSDFGQETSYIEDNCNQNGAISLIFSLKEEVGALAKVLRLFEENDVNLTHIESRPSRLKKDEYEFFTHLDKRSLPALTNIIKILRHDIGATVHELSRDKKKDTVPWFPRTIQELDRFANQILSYGAELDADHPGFKDPVYRARRKQFADIAYNYRHGQPIPRVEYMEEXKKTWGTVFKTLKSLYKTHACYEYNHIFPLLEKYCGFHEDNIPQLEDVSQFLQTCTGFRLRPVAGLLSSRDFLGGLAFRVFHCTQYIRHGSKPMYTPEPDICHELLGHVPLFSDRSFAQFSQEIGLASLGAPDEYIEKLATIYWFTVEFGLCKQGDSIKAYGAGLLSSFGELQYCLSEKPKLLPLELEKTAIQNYTVTEFQPLYYVAESFNDAKEKVRNFAATIPRPFSVRYDPYTQRIEVLDNTQDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 326 - protein, 1037 aa, Homo sapiens
  MISC_FEATURE (792): Xaa equals Glu or Gly
MKWVSFISLLFLFSSAYSRSLDKRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLMSTAVLENPGLGRKLSDFGQETSYIEDNCNQNGAISLIFSLKEEVGALAKVLRLFEENDVNLTHIESRPSRLKKDEYEFFTHLDKRSLPALTNIIKILRHDIGATVHELSRDKKKDTVPWFPRTIQELDRFANQILSYGAELDADHPGFKDPVYRARRKQFADIAYNYRHGQPIPRVEYMEEXKKTWGTVFKTLKSLYKTHACYEYNHIFPLLEKYCGFHEDNIPQLEDVSQFLQTCTGFRLRPVAGLLSSRDFLGGLAFRVFHCTQYIRHGSKPMYTPEPDICHELLGHVPLFSDRSFAQFSQEIGLASLGAPDEYIEKLATIYWFTVEFGLCKQGDSIKAYGAGLLSSFGELQYCLSEKPKLLPLELEKTAIQNYTVTEFQPLYYVAESFNDAKEKVRNFAATIPRPFSVRYDPYTQRIEVLDNTQ

SEQ ID NO: 327 - protein, 1037 aa, Homo sapiens
  MISC_FEATURE (207): Xaa equals Glu or Gly
MKWVSFISLLFLFSSAYSRSLDKRMSTAVLENPGLGRKLSDFGQETSYIEDNCNQNGAISLIFSLKEEVGALAKVLRLFEENDVNLTHIESRPSRLKKDEYEFFTHLDKRSLPALTNIIKILRHDIGATVHELSRDKKKDTVPWFPRTIQELDRFANQILSYGAELDADHPGFKDPVYRARRKQFADIAYNYRHGQPIPRVEYMEEXKKTWGTVFKTLKSLYKTHACYEYNHIFPLLEKYCGFHEDNIPQLEDVSQFLQTCTGFRLRPVAGLLSSRDFLGGLAFRVFHCTQYIRHGSKPMYTPEPDICHELLGHVPLFSDRSFAQFSQEIGLASLGAPDEYIEKLATIYWFTVEFGLCKQGDSIKAYGAGLLSSFGELQYCLSEKPKLLPLELEKTAIQNYTVTEFQPLYYVAESFNDAKEKVRNFAATIPRPFSVRYDPYTQRIEVLDNTQDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 328 - protein, 960 aa, Homo sapiens
  MISC_FEATURE (691): Xaa equals Glu or Gly
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLIGATVHELSRDKKKDTVPWFPRTIQELDRFANQILSYGAELDADHPGFKDPVYRARRKQFADIAYNYRHGQPIPRVEYMEEXKKTWGTVFKTLKSLYKTHACYEYNHIFPLLEKYCGFHEDNIPQLEDVSQFLQTCTGFRLRPVAGLLSSRDFLGGLAFRVFHCTQYIRHGSKPMYTPEPDICHELLGHVPLFSDRSFAQFSQEIGLASLGAPDEYIEKLATIYWFTVEFGLCKQGDSIKAYGAGLLSSFGELQYCLSEKPKLLPLELEKTAIQNYTVTEFQPLYYVAESFNDAKEKVRNFAATIPRPFSVRYDPYTQRIEVLDNTQQLKILADSINSEIGILCSALQKIK

SEQ ID NO: 329 - protein, 960 aa, Homo sapiens
  MISC_FEATURE (106): Xaa equals Glu or Gly
MKWVTFISLLFLFSSAYSRGVFRRIGATVHELSRDKKKDTVPWFPRTIQELDRFANQILSYGAELDADHPGFKDPVYRARRKQFADIAYNYRHGQPIPRVEYMEEXKKTWGTVFKTLKSLYKTHACYEYNHIFPLLEKYCGFHEDNIPQLEDVSQFLQTCTGFRLRPVAGLLSSRDFLGGLAFRVFHCTQYIRHGSKPMYTPEPDICHELLGHVPLFSDRSFAQFSQEIGLASLGAPDEYIEKLATIYWFTVEFGLCKQGDSIKAYGAGLLSSFGELQYCLSEKPKLLPLELEKTAIQNYTVTEFQPLYYVAESFNDAKEKVRNFAATIPRPFSVRYDPYTQRIEVLDNTQQLKILADSINSEIGILCSALQKIKDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 330 - protein, 960 aa, Homo sapiens
  MISC_FEATURE (691): Xaa equals Glu or Gly
MKWVSFISLLFLFSSAYSRSLDKRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLIGATVHELSRDKKKDTVPWFPRTIQELDRFANQILSYGAELDADHPGFKDPVYRARRKQFADIAYNYRHGQPIPRVEYMEEXKKTWGTVFKTLKSLYKTHACYEYNHIFPLLEKYCGFHEDNIPQLEDVSQFLQTCTGFRLRPVAGLLSSRDFLGGLAFRVFHCTQYIRHGSKPMYTPEPDICHELLGHVPLFSDRSFAQFSQEIGLASLGAPDEYIEKLATIYWFTVEFGLCKQGDSIKAYGAGLLSSFGELQYCLSEKPKLLPLELEKTAIQNYTVTEFQPLYYVAESFNDAKEKVRNFAATIPRPFSVRYDPYTQRIEVLDNTQQLKILADSINSEIGILCSALQKIK

SEQ ID NO: 331 - protein, 960 aa, Homo sapiens
  MISC_FEATURE (106): Xaa equals Glu or Gly
MKWVSFISLLFLFSSAYSRSLDKRIGATVHELSRDKKKDTVPWFPRTIQELDRFANQILSYGAELDADHPGFKDPVYRARRKQFADIAYNYRHGQPIPRVEYMEEXKKTWGTVFKTLKSLYKTHACYEYNHIFPLLEKYCGFHEDNIPQLEDVSQFLQTCTGFRLRPVAGLLSSRDFLGGLAFRVFHCTQYIRHGSKPMYTPEPDICHELLGHVPLFSDRSFAQFSQEIGLASLGAPDEYIEKLATIYWFTVEFGLCKQGDSIKAYGAGLLSSFGELQYCLSEKPKLLPLELEKTAIQNYTVTEFQPLYYVAESFNDAKEKVRNFAATIPRPFSVRYDPYTQRIEVLDNTQQLKILADSINSEIGILCSALQKIKDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 332 - protein, 720 aa, Homo sapiens
MKWVSFISLLFLFSSAYSGSLDKRHSQGTFTSDYSKYLDSRAAQDFVQWLMNTGRNRNNIAHSQGTFTSDYSKYLDSRAAQDFVQWLMNTGRNRNNIAHSQGTFTSDYSKYLDSRAAQDFVQWLMNTGRNRNNIADAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 333 - protein, 37 aa, Homo sapiens; identical to SEQ ID NO: 133

SEQ ID NO: 334 - protein, 37 aa, Homo sapiens; identical to SEQ ID NO: 133

SEQ ID NO: 335 - protein, 37 aa, Homo sapiens; identical to SEQ ID NO: 133

SEQ ID NO: 336 - protein, 28 aa, Homo sapiens
SANSNPAMAPRERKAGCKNFFWKTFTSC

SEQ ID NO: 337 - protein, 28 aa, Homo sapiens
SANSNPAMAPRERKAGCKNFFWKTFTSC

SEQ ID NO: 338 - protein, 602 aa, Homo sapiens; identical to SEQ ID NO: 145

SEQ ID NO: 339 - protein, 40 aa, Homo sapiens
DNPSLSIDLTFHLLRTLLELARTQSQRERAEQNRIIFDSV

SEQ ID NO: 340 - protein, 40 aa, Homo sapiens; identical to SEQ ID NO: 339

SEQ ID NO: 341 - protein, 40 aa, Homo sapiens; identical to SEQ ID NO: 339

SEQ ID NO: 342 - protein, 40 aa, Homo sapiens; identical to SEQ ID NO: 339

SEQ ID NO: 343 - protein, 38 aa, Homo sapiens
IVLSLDVPIGLLQILLEQARARAAREQATTNARILARV

SEQ ID NO: 344 - protein, 38 aa, Homo sapiens; identical to SEQ ID NO: 343

SEQ ID NO: 345 - protein, 38 aa, Homo sapiens; identical to SEQ ID NO: 343

SEQ ID NO: 346 - protein, 38 aa, Homo sapiens; identical to SEQ ID NO: 343

SEQ ID NO: 347 - protein, 602 aa, Homo sapiens; identical to SEQ ID NO: 145

SEQ ID NO: 348 - protein, 602 aa, Homo sapiens; identical to SEQ ID NO: 145

SEQ ID NO: 349 - protein, 40 aa, Homo sapiens; identical to SEQ ID NO: 339

SEQ ID NO: 350 - protein, 40 aa, Homo sapiens; identical to SEQ ID NO: 339

SEQ ID NO: 351 - protein, 38 aa, Homo sapiens; identical to SEQ ID NO: 343

SEQ ID NO: 352 - protein, 38 aa, Homo sapiens; identical to SEQ ID NO: 343

SEQ ID NO: 353 - protein, 40 aa, Homo sapiens; identical to SEQ ID NO: 339

SEQ ID NO: 354 - protein, 40 aa, Homo sapiens; identical to SEQ ID NO: 339

SEQ ID NO: 355 - protein, 38 aa, Homo sapiens; identical to SEQ ID NO: 343

SEQ ID NO: 356 - protein, 38 aa, Homo sapiens; identical to SEQ ID NO: 343

SEQ ID NO: 357 - protein, 497 aa, Homo sapiens; identical to SEQ ID NO: 165

SEQ ID NO: 358 - protein, 497 aa, Homo sapiens; identical to SEQ ID NO: 165

SEQ ID NO: 359 - protein, 153 aa, Homo sapiens; identical to SEQ ID NO: 142

SEQ ID NO: 360 - protein, 153 aa, Homo sapiens; identical to SEQ ID NO: 142

SEQ ID NO: 361 - protein, 602 aa, Homo sapiens; identical to SEQ ID NO: 145

SEQ ID NO: 362 - protein, 37 aa, Homo sapiens; identical to SEQ ID NO: 138

SEQ ID NO: 363 - protein, 37 aa, Homo sapiens; identical to SEQ ID NO: 138

SEQ ID NO: 364 - protein, 37 aa, Homo sapiens; identical to SEQ ID NO: 138

SEQ ID NO: 365 - protein, 37 aa, Homo sapiens; identical to SEQ ID NO: 138

SEQ ID NO: 366 - protein, 37 aa, Homo sapiens; identical to SEQ ID NO: 138

SEQ ID NO: 367 - protein, 37 aa, Homo sapiens; identical to SEQ ID NO: 138

SEQ ID NO: 368 - protein, 602 aa, Homo sapiens; identical to SEQ ID NO: 145

SEQ ID NO: 369 - protein, 602 aa, Homo sapiens; identical to SEQ ID NO: 145

SEQ ID NO: 370 - protein, 602 aa, Homo sapiens; identical to SEQ ID NO: 145

SEQ ID NO: 371 - protein, 37 aa, Homo sapiens; identical to SEQ ID NO: 133

SEQ ID NO: 372 - protein, 37 aa, Homo sapiens; identical to SEQ ID NO: 133

SEQ ID NO: 373 - protein, 37 aa, Homo sapiens; identical to SEQ ID NO: 133

SEQ ID NO: 374 - protein, 497 aa, Homo sapiens; identical to SEQ ID NO: 165

SEQ ID NO: 375 - protein, 497 aa, Homo sapiens; identical to SEQ ID NO: 165

SEQ ID NO: 376 - protein, 497 aa, Homo sapiens; identical to SEQ ID NO: 165

SEQ ID NO: 377 - protein, 497 aa, Homo sapiens; identical to SEQ ID NO: 165

SEQ ID NO: 378 - protein, 37 aa, Homo sapiens; identical to SEQ ID NO: 133

SEQ ID NO: 379 - protein, 37 aa, Homo sapiens; identical to SEQ ID NO: 133

SEQ ID NO: 380 - protein, 532 aa, Homo sapiens
LGLEDDIIIATKNGKVRGMQLTVFGGTVTAFLGIPYAQPPLGRLRFKKPQSLTKWSDIWQATKYANSCCQNIDQSFPGFHGSEMWNPNTDLSEDCLYLNVWIPAPKPKQATVLIWIYGGGFQTGTSSLHVYDGKFLARVERVIVVSMNYRVGALGFLALPGNPEAPGNMGLFDQQLALQWVQKNIAAFGGNPKSVTLFGESAGAASVSLHLLSPGSHSLFTRAILQSGSFNAPWAVTSLYEARQRTLNLAKLTGCSREQETEIIKCLRNKDPQEILLNEAFVVPYGTPLSVNFGPTVDGDFLTDMPDILLELGQFKKTQILVGVNKDEGTAFLVYGAPGFSKDQNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDQYTKAEEILSRSIVKRWANFAKYGNPQETQNQSTSWPVFKSTEQKYLTLNTESTRIMTKLRAQQCRFWTSFFPKV

SEQ ID NO: 381 - protein, 602 aa, Homo sapiens; identical to SEQ ID NO: 145

SEQ ID NO: 382 - protein, 602 aa, Homo sapiens; identical to SEQ ID NO: 145

SEQ ID NO: 383 - protein, 602 aa, Homo sapiens; identical to SEQ ID NO: 145

SEQ ID NO: 384 - protein, 497 aa, Homo sapiens; identical to SEQ ID NO: 165

SEQ ID NO: 385 - protein, 37 aa, Homo sapiens; identical to SEQ ID NO: 133

SEQ ID NO: 386 - protein, 37 aa, Homo sapiens; identical to SEQ ID NO: 133

SEQ ID NO: 387 - protein, 602 aa, Homo sapiens; identical to SEQ ID NO: 145

SEQ ID NO: 388 - protein, 602 aa, Homo sapiens; identical to SEQ ID NO: 145

SEQ ID NO: 389 - protein, 602 aa, Homo sapiens; identical to SEQ ID NO: 145

SEQ ID NO: 390 - protein, 602 aa, Homo sapiens; identical to SEQ ID NO: 145

SEQ ID NO: 391 - protein, 529 aa, Homo sapiens
EDDIIIATKNGKVRGMQLTVFGGTVTAFLGIPYAQPPLGRLRFKKPQSLTKWSDIWQATKYANSCCQNIDQSFPGFHGSEMWNPNTDLSEDCLYLNVWIPAPKPKQATVLIWIYGGGFQTGTSSLHVYDGKFLARVERVIVVSMNYRVGALGFLALPGNPEAPGNMGLFDQQLALQWVQKNIAAFGGNPKSVTLFGESAGAASVSLHLLSPGSHSLFTRAILQSGSFNAPWAVTSLYEARQRTLNLAKLTGCSREQETEIIKCLRNKDPQEILLNEAFVVPYGTPLSVNFGPTVDGDFLTDMPDILLELGQFKKTQILVGVNKDEGTAFLVYGAPGFSKDQNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDQYTKAEEILSRSIVKRWANFAKYGNPQETQNQSTSWPVFKSTEQKYLTLNTESTRIMTKLRAQQCRFWTSFFPKV

SEQ ID NO: 392 - protein, 497 aa, Homo sapiens; identical to SEQ ID NO: 165

SEQ ID NO: 393 - protein, 29 aa, Homo sapiens
HSQGTFTSDYSKYLDSRRAQDFVQWLMNT

SEQ ID NO: 394 - protein, 29 aa, Homo sapiens
HSQGTFTSDYSKYLDSRRAQDFVQWLMNT

SEQ ID NO: 395 - protein, 29 aa, Homo sapiens
HSQGTFTSDYSKYLDSRRAQDFVQWLMNT

SEQ ID NO: 396 - protein, 452 aa, Homo sapiens
  MISC_FEATURE (183): Xaa equals Glu or Gly
MSTAVLENPGLGRKLSDFGQETSYIEDNCNQNGAISLIFSLKEEVGALAKVLRLFEENDVNLTHIESRPSRLKKDEYEFFTHLDKRSLPALTNIIKILRHDIGATVHELSRDKKKDTVPWFPRTIQELDRFANQILSYGAELDADHPGFKDPVYRARRKQFADIAYNYRHGQPIPRVEYMEEXKKTWGTVFKTLKSLYKTHACYEYNHIFPLLEKYCGFHEDNIPQLEDVSQFLQTCTGFRLRPVAGLLSSRDFLGGLAFRVFHCTQYIRHGSKPMYTPEPDICHELLGHVPLFSDRSFAQFSQEIGLASLGAPDEYIEKLATIYWFTVEFGLCKQGDSIKAYGAGLLSSFGELQYCLSEKPKLLPLELEKTAIQNYTVTEFQPLYYVAESFNDAKEKVRNFAATIPRPFSVRYDPYTQRIEVLDNTQQLKILADSINSEIGILCSALQKIK

SEQ ID NO: 397 - protein, 29 aa, Homo sapiens
HSQGTFTSDYSKYLDSRRAQDFVQWLMNT

SEQ ID NO: 398 - protein, 29 aa, Homo sapiens
HSQGTFTSDYSKYLDSRRAQDFVQWLMNT

SEQ ID NO: 399 - protein, 602 aa, Homo sapiens; identical to SEQ ID NO: 145

SEQ ID NO: 400 - protein, 452 aa, Homo sapiens; identical to SEQ ID NO: 396
  MISC_FEATURE (183): Xaa equals Glu or Gly

SEQ ID NO: 401 - protein, 452 aa, Homo sapiens; identical to SEQ ID NO: 396
  MISC_FEATURE (183): Xaa equals Glu or Gly

SEQ ID NO: 402 - protein, 452 aa, Homo sapiens; identical to SEQ ID NO: 396
  MISC_FEATURE (183): Xaa equals Glu or Gly

SEQ ID NO: 403 - protein, 452 aa, Homo sapiens; identical to SEQ ID NO: 396
  MISC_FEATURE (183): Xaa equals Glu or Gly

SEQ ID NO: 404 - protein, 452 aa, Homo sapiens; identical to SEQ ID NO: 396
  MISC_FEATURE (183): Xaa equals Glu or Gly

SEQ ID NO: 405 - protein, 37 aa, Homo sapiens; identical to SEQ ID NO: 133

SEQ ID NO: 406 - protein, 452 aa, Homo sapiens; identical to SEQ ID NO: 396
  MISC_FEATURE (183): Xaa equals Glu or Gly

SEQ ID NO: 407 - protein, 452 aa, Homo sapiens; identical to SEQ ID NO: 396
  MISC_FEATURE (183): Xaa equals Glu or Gly

SEQ ID NO: 408 - protein, 452 aa, Homo sapiens; identical to SEQ ID NO: 396
  MISC_FEATURE (183): Xaa equals Glu or Gly

SEQ ID NO: 409 - protein, 452 aa, Homo sapiens; identical to SEQ ID NO: 396
  MISC_FEATURE (183): Xaa equals Glu or Gly

SEQ ID NO: 410 - protein, 452 aa, Homo sapiens; identical to SEQ ID NO: 396
  MISC_FEATURE (183): Xaa equals Glu or Gly

SEQ ID NO: 411 - protein, 452 aa, Homo sapiens; identical to SEQ ID NO: 396
  MISC_FEATURE (183): Xaa equals Glu or Gly

SEQ ID NO: 412 - protein, 452 aa, Homo sapiens; identical to SEQ ID NO: 396
  MISC_FEATURE (183): Xaa equals Glu or Gly

SEQ ID NO: 413 - protein, 452 aa, Homo sapiens; identical to SEQ ID NO: 396
  MISC_FEATURE (183): Xaa equals Glu or Gly

SEQ ID NO: 414 - protein, 37 aa, Homo sapiens; identical to SEQ ID NO: 133

SEQ ID NO: 415 - DNA, 38 bp, Homo sapiens
aggagcgtcgacaaaagatctgctaactcaaacccggc

SEQ ID NO: 416 - DNA, 59 bp, Homo sapiens
agtcccatcgatgagcaacctcactcttgtgtgcatcacaggatgtgaaagtcttccag

SEQ ID NO: 417 - DNA, 37 bp, Homo sapiens
aagctgccttaggcttatctgctaactcaaacccggc

SEQ ID NO: 418 - DNA, 33 bp, Homo sapiens
ttggcgcgccctaacaggatgtgaaagtcttcc

SEQ ID NO: 419 - DNA, 28 bp, Homo sapiens
catgctgccttaggcttagacaaccctt

SEQ ID NO: 420 - DNA, 27 bp, Homo sapiens
ctataaggcgcgccctacaccgagtcg

SEQ ID NO: 421 - DNA, 50 bp, Homo sapiens
ccgccgctcgaggggtgtgtttcgtcgagacaacccttctctgtccattg

SEQ ID NO: 422 - DNA, 64 bp, Homo sapiens
agtcccatcgatgagcaacctcactcttgtgtgcatccaccgagtcgaatatgatgcggttctg

SEQ ID NO: 423 - DNA, 50 bp, Homo sapiens; identical to SEQ ID NO: 421

SEQ ID NO: 424 - DNA, 64 bp, Homo sapiens
agtcccatcgatgagcaacctcactcttgtgtgcatctacggagtcaaatattatgcgattttg

SEQ ID NO: 425 - DNA, 51 bp, Homo sapiens
ccgccgctcgaggggtgtgtttcgtcgaattgtcctatcgctggatgtccc

SEQ ID NO: 426 - DNA, 56 bp, Homo sapiens
agtcccatcgatgagcaacctcactcttgtgtgcatcgacacgggccaggatgcgg

SEQ ID NO: 427 - DNA, 51 bp, Homo sapiens; identical to SEQ ID NO: 425

SEQ ID NO: 428 - DNA, 63 bp, Homo sapiens
agtcccatcgatgagcaacctcactcttgtgtgcatccacacgcgccaggattcgcgcgtttg

SEQ ID NO: 429 - DNA, 40 bp, Homo sapiens
cacgatacgccttaggcttagaagatgacatcataattgc

SEQ ID NO: 430 - DNA, 45 bp, Homo sapiens
catatatggcgcgcctcattagacttttggaaaaaatgatgtcca

SEQ ID NO: 431 - DNA, 37 bp, Homo sapiens
aagctgccttaggcttagcccgcccctgcatccctaa

SEQ ID NO: 432 - DNA, 32 bp, Homo sapiens
ttggcgcgcctcactggcgacgccacaggtag

SEQ ID NO: 433 - DNA, 40 bp, Homo sapiens
gctatataccgcggcgcccgcccctgcatccctaaaagct

SEQ ID NO: 434 - DNA, 58 bp, Homo sapiens
ccttaaatcgatgagcaacctcactcttgtgtgcatcctggcgacgccacaggtaggt

SEQ ID NO: 435 - DNA, 53 bp, Homo sapiens
ccgccgctcgaggggtgtgtttcgtcgaggaccggagacgctctgcggggctg

SEQ ID NO: 436 - DNA, 65 bp, Homo sapiens
agtcccatcgatgagcaacctcactcttgtgtgcatcagctgacttggcaggcttgaggggtgcg

SEQ ID NO: 437 - DNA, 43 bp, Homo sapiens
caagctgccttaggcttaggaccggagacgctctgcggggctg

SEQ ID NO: 438 - DNA, 44 bp, Homo sapiens
catcatggtaccttaagctgacttggcaggcttgaggggtgcgc

SEQ ID NO: 439 - DNA, 31 bp, Homo sapiens
gaaaggccgcggcgtgactcatcggctggca

SEQ ID NO: 440 - DNA, 21 bp, Homo sapiens
catgatcttcaaatggacact

SEQ ID NO: 441 - DNA, 32 bp, Homo sapiens
gcatagccgcggcctggcaggcttgctgagca

SEQ ID NO: 442 - DNA, 21 bp, Homo sapiens
catgatcttcaaatggacact

SEQ ID NO: 443 - DNA, 21 bp, Homo sapiens
agaagtgctgcaaggctgacg

SEQ ID NO: 444 - DNA, 20 bp, Homo sapiens
acctgacctacaggaaagag

SEQ ID NO: 445 - DNA, 21 bp, Homo sapiens
agaagtgctgcaaggctgacg

SEQ ID NO: 446 - DNA, 20 bp, Homo sapiens
acctgacctacaggaaagag

SEQ ID NO: 447 - DNA, 44 bp, Homo sapiens
caagctgccttaggcttagtgactcatcggctggcaggcttgct

SEQ ID NO: 448 - DNA, 47 bp, Homo sapiens
gcatatggcgcgccttatcagccaaaggctttggaacccacattggt

SEQ ID NO: 449 - DNA, 39 bp, Homo sapiens
caagctgccttaggcttactggcaggcttgctgagcaga

SEQ ID NO: 450 - DNA, 47 bp, Homo sapiens; identical to SEQ ID NO: 448

SEQ ID NO: 451 - DNA, 37 bp, Homo sapiens; identical to SEQ ID NO: 431

SEQ ID NO: 452 - DNA, 32 bp, Homo sapiens; identical to SEQ ID NO: 432

SEQ ID NO: 453 - DNA, 29 bp, Homo sapiens
tcccgcccgcggcgaagatgacatcataa

SEQ ID NO: 454 - DNA, 21 bp, Homo sapiens
catgatcttcaaatggacact

SEQ ID NO: 455 - DNA, 29 bp, Homo sapiens
tcccgcccgcggcgaagatgacatcataa

SEQ ID NO: 456 - DNA, 21 bp, Homo sapiens
catgatcttcaaatggacact

SEQ ID NO: 457 - DNA, 29 bp, Homo sapiens
tcccgcccgcggcgaagatgacatcataa

SEQ ID NO: 458 - DNA, 21 bp, Homo sapiens
catgatcttcaaatggacact

SEQ ID NO: 459 - DNA, 40 bp, Homo sapiens; identical to SEQ ID NO: 429

SEQ ID NO: 460 - DNA, 45 bp, Homo sapiens; identical to SEQ ID NO: 430

SEQ ID NO: 461 - DNA, 43 bp, Homo sapiens
aagctgccttaggcttaaccttcagccgctatgagagtacacg

SEQ ID NO: 462 - DNA, 36 bp, Homo sapiens
aggcgcgccttatcctccttcggggttcagggcaag

SEQ ID NO: 463 - DNA, 59 bp, Homo sapiens
gcttattccggaagcctcgacaaaagacattcacaaggtacattcactagtgattattc

SEQ ID NO: 464 - DNA, 57 bp, Homo sapiens
ctttaaatcgatgagcaacctcactcttgtgtgcatcagtattcatcaaccattgaa

SEQ ID NO: 465 - DNA, 59 bp, Homo sapiens; identical to SEQ ID NO: 463

SEQ ID NO: 466 - DNA, 57 bp, Homo sapiens; identical to SEQ ID NO: 464

SEQ ID NO: 467 - DNA, 50 bp, Homo sapiens
gtcagagccttaggcttacattcacaaggtacattcactagtgattattc

SEQ ID NO: 468 - DNA, 37 bp, Homo sapiens
ccatccggcgcgccttaagtattcatcaaccattgaa

SEQ ID NO: 469 - DNA, 47 bp, Homo sapiens
agacttccggaagcctcgacaaaagatcacaaggtacattcactagt

SEQ ID NO: 470 - DNA, 57 bp, Homo sapiens; identical to SEQ ID NO: 464

SEQ ID NO: 471 - DNA, 47 bp, Homo sapiens
gtcagagccttaggcttatcacaaggtacattcactagtgattattc

SEQ ID NO: 472 - DNA, 37 bp, Homo sapiens; identical to SEQ ID NO: 468

SEQ ID NO: 473 - DNA, 40 bp, Homo sapiens; identical to SEQ ID NO: 429

SEQ ID NO: 474 - DNA, 45 bp, Homo sapiens; identical to SEQ ID NO: 430

SEQ ID NO: 475 - DNA, 51 bp, Homo sapiens
ttaacgtgctgccttaggcttaattggtgccactgtccatgagctttcacg

SEQ ID NO: 476 - DNA, 43 bp, Homo sapiens
aggcgcgccttactgggtattgtccaagacctcaatcctttgg

SEQ ID NO: 477 - DNA, 43 bp, Homo sapiens
gcccccgcccgcggattggtgccactgtccatgagctttcacg

SEQ ID NO: 478 - DNA, 68 bp, Homo sapiens
agtcccatcgatgagcaacctcactcttgtgtgcatcctgggtattgtccaagacctcaatcctttgg

SEQ ID NO: 479 - DNA, 51 bp, Homo sapiens; identical to SEQ ID NO: 475

SEQ ID NO: 480 - DNA, 43 bp, Homo sapiens; identical to SEQ ID NO: 476

SEQ ID NO: 481 - DNA, 42 bp, Homo sapiens
gcccccggtcgacattggtgccactgtccatgagctttcacg

SEQ ID NO: 482 - DNA, 68 bp, Homo sapiens; identical to SEQ ID NO: 478

SEQ ID NO: 483 - DNA, 44 bp, Homo sapiens
cgtgctgccttaggagttgacacagtgccctggttcccaagaac

SEQ ID NO: 484 - DNA, 43 bp, Homo sapiens; identical to SEQ ID NO: 476

SEQ ID NO: 485 - DNA, 111 bp, Homo sapiens; identical to SEQ ID NO: 169

SEQ ID NO: 486 - DNA, 111 bp, Homo sapiens; identical to SEQ ID NO: 169

SEQ ID NO: 487 - protein, 708 aa, Homo sapiens
MRFPSIFTAVLAFAASSALAAPVNTTTEDETAQIPAEAVIGYSDLEGDFDVAVLPFSNSTNNGLLFINTTIASIAAKEEGVSLEKRHSQGTFTSDYSKYLDSRRAQDFVQWLMNTKRNRNNIADAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 488 - protein, 745 aa, Homo sapiens
MRFPSIFTAVLAFAASSALAAPVNTTTEDETAQIPAEAVIGYSDLEGDFDVAVLPFSNSTNNGLLFINTTIASIAAKEEGVSLEKRHSQGTFTSDYSKYLDSRRAQDFVQWLMNTKRNRNNIAHSQGTFTSDYSKYLDSRRAQDFVQWLMNTKRNRNNIADAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 489 - protein, 37 aa, Homo sapiens; identical to SEQ ID NO: 133

SEQ ID NO: 490 - protein, 37 aa, Homo sapiens; identical to SEQ ID NO: 133

SEQ ID NO: 491 - DNA, 1755 bp, Homo sapiens
gatgctcacaagtctgaagttgctcatcgattcaaggatttgggtgaagaaaacttcaaggctttggttttgattgctttcgctcaatacttgcaacaatgtccattcgaagatcacgttaagttggttaacgaagttactgaattcgctaagacttgtgttgctgatgaatctgctgaaaactgtgataagtctttgcacactttgttcggtgataagttgtgtactgttgctactttgagagaaacttacggtgaaatggctgattgttgtgctaagcaagaaccagaaagaaacgaatgtttcttgcaacacaaggatgataacccaaacttgccaagattggttagaccagaagttgatgttatgtgtactgctttccacgataacgaagaaactttcttgaagaagtacttgtacgaaattgctagaagacacccatacttctacgctccagaattgttgttcttcgctaagagatacaaggctgctttcactgaatgttgtcaagctgctgataaggctgcttgtttgttgccaaagttggatgaattgagagatgaaggtaaggcttcttctgctaagcaaagattgaagtgtgcttctttgcaaaagttcggtgaaagagctttcaaggcttgggctgttgctagattgtctcaaagattcccaaaggctgaattcgctgaagtttctaagttggttactgatttgactaaggttcacactgaatgttgtcacggtgatttgttggaatgtgctgatgatagagctgatttggctaagtacatttgtgaaaaccaagattctatttcttctaagttgaaggaatgttgtgaaaagccattgttggaaaagtctcactgtattgctgaagttgaaaacgatgaaatgccagctgatttgccatctttggctgctgatttcgttgaatctaaggatgtttgtaagaactacgctgaagctaaggatgttttcttgggtatgttcttgtacgaatacgctagaagacacccagattactctgttgttttgttgttgagattggctaagacttacgaaactactttggaaaagtgttgtgctgctgctgatccacacgaatgttacgctaaggttttcgatgaattcaagccattggttgaagaaccacaaaacttgattaagcaaaactgtgaattgttcgaacaattgggtgaatacaagttccaaaacgctttgttggttagatacactaagaaggttccacaagtttctactccaactttggttgaagtttctagaaacttgggtaaggttggttctaagtgttgtaagcacccagaagctaagagaatgccatgtgctgaagattacttgtctgttgttttgaaccaattgtgtgttttgcacgaaaagactccagtttctgatagagttactaagtgttgtactgaatctttggttaacagaagaccatgtttctctgctttggaagttgatgaaacttacgttccaaaggaattcaacgctgaaactttcactttccacgctgatatttgtactttgtctgaaaaggaaagacaaattaagaagcaaactgctttggttgaattggttaagcacaagccaaaggctactaaggaacaattgaaggctgttatggatgatttcgctgctttcgttgaaaagtgttgtaaggctgatgataaggaaacttgtttcgctgaagaaggtaagaagttggttgctgcttctcaagctgccttaggctta

SEQ ID NO: 492 - protein, 585 aa, Homo sapiens [sequence omitted]

---

What is claimed:

1. An albumin fusion protein comprising a Butyrylcholinesterase (BChE) polypeptide fused to an albumin polypeptide, wherein said albumin fusion protein comprises amino acids 24-1137 of SEQ ID NO: 306.

2. The albumin fusion protein of claim 1, which is non-glycosylated.

3. The albumin fusion protein of claim 1, which is expressed in yeast.

4. The albumin fusion protein of claim 3, wherein the yeast is glycosylation deficient.

5. The albumin fusion protein of claim 3, wherein the yeast is glycosylation and protease deficient.

6. The albumin fusion protein of claim 1, which is expressed by a mammalian cell.

7. The albumin fusion protein of claim 1, wherein the albumin fusion protein is expressed by a mammalian cell in culture.

8. The albumin fusion protein of claim 1, wherein the albumin fusion protein is expressed by a bacterial cell.

9. The albumin fusion protein of claim 1, wherein the albumin fusion protein further comprises a secretion leader sequence.

10. A composition comprising the albumin fusion protein of claim 1 and a pharmaceutically acceptable carrier.

11. A kit comprising the composition of claim 10.

12. The albumin fusion protein of claim 7, wherein said mammalian cell is a COS cell, a CHO cell, or a NSO cell.

13. A method of producing an albumin fusion protein comprising:

(a) culturing an isolated host cell comprising a nucleic acid molecule comprising a polynucleotide encoding the albumin fusion protein of claim 1 in conditions such that the albumin fusion protein is expressed; and (b) recovering the albumin fusion protein.

14. The albumin fusion protein produced by the method of claim 13.

* * * * *

UNITED STATES PATENT AND TRADEMARK OFFICE

CERTIFICATE OF CORRECTION

PATENT NO. : 8,334,365 B2
APPLICATION NO. : 11/759843
DATED : December 18, 2012
INVENTOR(S) : Rosen et al.

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 1082 days.

Signed and Sealed this
Eleventh Day of November, 2014

Michelle K. Lee
*Deputy Director of the United States Patent and Trademark Office*